United States Patent 12,569,549 (FLAVIVIRUS VACCINE) - sequence listing, part 16

SEQ ID NO: 7990 - RNA, 9879 nt, synthetic construct
  misc_feature 1..9879: note = derived and/or modified CDS sequence (opt1) from DENV-1__GU131892__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgcgggcatcctcgtgcaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcaccctggccgtgttcctgctcctgatcatggggcagctgacgtggaacgacctcatccgcctgtgcatcatggtcggcgccaacgcgagcgaccgcatggggatgggcaccacctacctggccctcatggccaccttcaagatgcggccgatgttcgccgtggggctgctgttccgccggctcacgtcccgcgaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccttctccctgcactacgcctggaagaccatggccatggtcctcagcatcgtgtccctgttccccctgtgcctcagcacgacctcccagaagaccacctggctgcccgtgctgctcggcagcctggggtgcaagccgctgacgatgttcctcatcgcggagaacaagatctggggccggcgctcctggcccctgaacgaggggatcatggccgtcggcatcgtgagcatcctgctcagctccctgctgaagaacgacgtgcccctcgccgggcccctgatcgccggcggcatgctgatcgcctgctacgtcatcagcgggtccagcgcggacctctccctggagaaggccgccgaggtgagctgggaggaggaggccgagcactccggcgccagccacaacatcctggtggaggtccaggacgacgggaccatgaagatcaaggacgaggagcgggacgacaccctcaccatcctgctgaaggcgaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgccgtcctgatgtaccaggggaagcgcctggagcccagctgggcgtccgtgaagaaggacctcatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgccatcgccctggacttcaagcccgggacgagcggctcccccatcgtgaaccgcgaggggaagatcgtgggcctctacggcaacggggtcgtgaccaccagcggcacctacgtgagcgcgatcgcccaggccaaggcctcccaggaggggccgctgcccgagatcgaggacgaggtcttccggaagcgcaacctgacgatcatggacctccaccccggcagcgggaagacccggcgctacctgccggcgatcgtgcgggaggccatcaagcgcaagctgcgcaccctcatcctggcccccacccgggtggtcgcctccgagatggccgaggcgctgaagggcatgcccatccgctaccagacgaccgccgtcaagagcgagcacaccggcaaggagatcgtggacctcatgtgccacgccaccttcacgatgcggctgctgtcccccgtccgcgtgccgaactacaacatgatcatcatggacgaggcccacttcaccgaccccagctccatcgccgcgcgggggtacatcagcacccgcgtgggcatgggggaggccgccgccatcttcatgaccgccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctccggaagaacgggaagcgcgtgatccagctgtcccggaagaccttcgacacggagtaccagaagaccaagaacaacgactgggactacgtggtcaccaccgacatcagcgagatgggcgccaacttccgcgcggaccgggtgatcgacccgcgccggtgcctgaagcccgtgatcctcaaggacgggcccgagcgcgtcatcctggccggccccatgccggtgacggtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagaccttcgtggagctgatgcgccgcggggacctgcccgtgtggctctcctacaaggtcgccagcgagggcttccagtacagcgaccgccggtggtgcttcgacggcgagcgcaacaaccaggtgctggaggagaacatggacgtggagatctggacgaaggagggggagcggaagaagctgcgcccccggtggctcgacgcccgcacctactccgaccccctggccctgcgggagttcaaggagttcgccgcgggccgccggagcgtctccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacaccatcgagacgctgatgctcctggccctgatcgccgtgctcaccggcggggtcaccctgttcttcctgtccggccgggggctcggcaagaccagcatcggcctgctgtgcgtgatggcctccagcgtgctcctgtggatggcctccgtcgagccccactggatcgcggccagcatcatcctggagttcttcctcatggtgctgctgatccccgagccggaccgccagcggacgccccaggacaaccagctcgcctacgtggtcatcgggctgctgttcatgatcctcacggtggccgccaacgagatgggcctgctggagaccaccaagaaggacctcgggatcggccacgtggcggtcgggaaccaccaccacgccgccatgctggacgtggacctgcaccccgcctccgcctggaccctctacgcggtggccacgaccatcatcaccccgatgatgcgccacaccatcgagaacacgaccgccaacatcagcctgaccgccatcgccaaccaggcggccatcctgatgggcctcgacaagggctggcccatctccaagatggacatcggggtccccctgctggccctcggctgctacagccaggtgaaccccctgaccctgacggccgcggtgctcatgctggtcgcccactacgccatcatcgggccgggcctgcaggccaaggccacccgcgaggcgcagaagcggaccgccgccgggatcatgaagaaccccaccgtggacggcatcgtggccatcgacctcgaccccgtcgtgtacgacgccaagttcgagaagcagctgggccagatcatgctgctcatcctgtgcacgtcccagatcctgctcatgcgcaccacctgggcgctgtgcgagagcatcaccctggccacggggcccctcaccaccctgtgggagggctccccggggaagttctggaacaccacgatcgccgtgagcatggccaacatcttccggggctcctacctggccggcgcggggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtcgaccgcagcgaggccaaggaggggctcaagcggggcgagacgaccaagcacgcggtgtcccgcgggaccgccaagctgcggtggttcgtggagcgcaacctggtcaagcccgagggcaaggtgatcgacctgggctgcgggcggggcgggtggagctactactgcgccggcctcaagaaggtgaccgaggtcaaggggtacacgaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgaccatcgaggaggggcgcacgctgcgggtcctcaagatggtggagccctggctgcgcggcaaccagttctgcatcaagatcctgaacccctacatgcccagcgtggtcgagaccctcgagcagatgcagcggaagcacggcgggatgctggtgcgcaacccgctgtcccggaacagcacccacgagatgtactgggtgtcctgcggcaccgggaacatcgtcagcgccgtgaacatgacctcccgcatgctcctgaaccgcttcacgatggcgcaccggaagcccacctacgagcgcgacgtggacctgggcgccggcacccggcacgtcgccgtggagcccgaggtggccaacctcgacatcatcgggcagcgcatcgagaacatcaagcacgagcacaagagcacctggcactacgacgaggacaacccctacaagacgtgggcctaccacggctcctacgaggtcaagccgagcgggtccgcgagcagcatggtgaacggcgtcgtgaagctgctgaccaagccctgggacgtgatccccatggtcacccagatcgccatgaccgacacgacccccttcgggcagcagcgggtgttcaaggagaaggtggacacccgcaccccgaaggccaagcggggcacggcccagatcatggaggtcaccgccaagtggctctggggcttcctgtcccgcaacaagaagccccggatctgcacccgcgaggagttcacccggaaggtgcgcagcaacgcggccatcggggccgtgttcgtcgacgagaaccagtggaactccgccaaggaggcggtggaggacgagcggttctgggacctggtgcaccgcgagcgggagctccacaagcagggcaagtgcgccacgtgcgtctacaacatgatggggaagcgcgagaagaagctgggcgagttcgggaaggccaagggcagccgggccatctggtacatgtggctgggcgcccgcttcctcgagttcgaggcgctggggttcatgaacgaggaccactggttctcccgggagaacagcctgtccggcgtggagggggagggcctccacaagctggggtacatcctgcgcgacatcagcaagatccccggcggcaacatgtacgccgacgacaccgccgggtgggacacccggatcaccgaggacgacctccagaacgaggcccgcatcacggacatcatggagccggagcacgccctgctggcgaagtccatcttcaagctcacctaccagaacaaggtggtccgcgtgcagcggcccgccaagaacggcaccgtgatggacgtcatcagccgccgggaccagcgcgggtccggccaggtgggcacctacgggctgaacacgttcaccaacatggaggcccagctgatccggcagatggagagcgagggcatcttctcccccagcgagctcgagacccccaacctggccgagcgcgtgctggactggctcgagaagtacggggtcgagcggctgaagcgcatggccatctccggcgacgactgcgtggtgaagccgatcgacgaccggttcgcgaccgccctgacggccctcaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctggtggggcgggcccgcgtgagccagggcgccgggtggagcctccgggagaccgcgtgcctgggcaagtcctacgcccagatgtggcagctgatgtacttccaccgccgggacctccgcctggccgccaacgcgatctgcagcgccgtccccgtggactggatccccacctcccggaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctcggcaagcgcgaggaccagtggtgcggcagcctgatcgggctgacggcccgggccacctgggcgaccaacatccaggtggccatcaaccaggtccgccggctcatcggcaacgagaactacctggactacatgacctccatgaagcgcttcaagaacgagagcgaccccgagggggccctgtggtga

SEQ ID NO: 7991 - RNA, 9879 nt, synthetic construct
  misc_feature 1..9879: note = derived and/or modified CDS sequence (opt1) from DENV-1__GU131893__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatgacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggccacgcagaacggccggctgatcaccgccaacccgatcgtcaccgacaaggagaagcccgtgaacatcgaggcggagccgcccttcggggagtcctacatcgtgatcggcgccggcgagaaggccctgaagctcagctggttcaagaaggggtccagcatcggcaagatgttcgaggccaccgcccgcggggcgcggcgcatggccatcctgggcgacacggcctgggacttcgggtccatcggcggcgtcttcaccagcgtggggaagctggtgcaccagatcttcggcaccgcctacggggtcctcttctccggcgtgagctggaccatgaagatcgggctgggcgtgctgctcacgtggctgggcctgaactcccgcagcacctccctcagcatgacctgcatcgccgtcgggctggtgaccctgtacctcggcgtgatggtccaggcggactccgggtgcgtgatcaactggaagggccgggagctgaagtgcgggagcggcatcttcgtgacgaacgaggtccacacctggaccgagcagtacaagttccaggccgacagcccgaagcgcctgtccgccgccatcggcaaggcctgggaggagggggtgtgcggcatccggagcgcgacccgcctcgagaacatcatgtggaagcagatctccaacgagctgaaccacatcctgctcgagaacgacatgaagttcaccgtggtcgtgggggacgtggccggcatcctggcccaggggaagaagatgatccggccccagcccatggagtacaagtacagctggaagtcctggggcaaggccaagatcatcggcgcggacgtccagaacacgaccttcatcatcgacgggcccaacaccccggagtgccccgacgaccagcgcgcctggaacatctgggaggtggaggactacggcttcgggatcttcaccacgaacatctggctgaagctccgggacagccacacccaggtgtgcgaccaccgcctgatgtccgccgccatcaaggacagcaaggccgtccacgcggacatgggctactggatcgagtccgagaagaacgagacctggaagctggcccgggccagcttcatcgaggtgaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtcgtggtggacgagcactgcggcaaccgggggccgtccctccgcaccaccaccgtcacgggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgctggtcccggaagatgctgatgaccggcaccctggcggtcttcctcctgctgatcatggggcagctcacgtggaacgacctgatccgcctgtgcatcatggtgggcgccaacgccagcgaccgcatggggatgggcaccacctacctcgccctgatggccaccttcaagatgcggccgatgttcgcggtggggctcctgttccgccggctgacgtcccgcgaggtcctgctcctgaccatcgggctgagcctcgtggcctccgtggagctgcccaacagcctggaggagctcggcgacgggctggccatgggcatcatgatcctgaagctcctgaccgacttccagtcccaccagctgtgggccaccctcctgagcctgacgttcatcaagaccaccttctccctccactacgcgtggaagaccatggccatggtcctgagcatcgtgtccctgttccccctctgcctgagcacgacctcccagaagaccacctggctgcccgtcctcctgggcagcctggggtgcaagccgctcacgatgttcctgatcgccgagaacaagatctggggccggcgctcctggcccctgaacgaggggatcatggccgtgggcatcgtgagcatcctcctgagctccctgctcaagaacgacgtccccctggccgggcccctgatcgcgggcggcatgctcatcgcctgctacgtgatcagcgggtccagcgccgacctgtccctggagaaggccgccgaggtgagctgggaggaggaggcggagcactccggcgccagccacaacatcctcgtcgaggtgcaggacgacgggaccatgaagatcaaggacgaggagcgggacgacaccctgaccatcctgctcaaggccaccctgctggccgtgtccggcgtctacccgctcagcatccccgccacgctgttcgtgtggtacttctggcagaagaagaagcagcgctccggggtgctgtgggacacccccagcccgcccgaggtcgagcgggcggtgctggacgacggcatctaccgcatcatgcagcggggcctcctggggcgctcccaggtgggcgtcggggtgttccaggagaacgtgttccacaccatgtggcacgtcacccggggcgccgtgctgatgtaccaggggaagcgcctcgagcccagctgggcctccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgcgatcgccctcgacttcaagcccgggacgagcggctcccccatcgtgaaccgcgaggggaagatcgtcggcctgtacggcaacggggtggtgaccaccagcggcacctacgtcagcgccatcgcccaggcgaaggcctcccaggaggggccgctgcccgagatcgaggacgaggtgttccggaagcgcaacctcacgatcatggacctgcaccccggcagcgggaagacccggcgctacctgccggccatcgtgcgggaggccatcaagcgcaagctccgcaccctgatcctggcccccacccgggtcgtggcgtccgagatggccgaggccctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcgcacttcaccgaccccagctccatcgccgcccgggggtacatcagcacccgcgtcggcatgggggaggccgccgcgatcttcatgaccgccacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgcgaactgcctgcggaagaacgggaagcgcgtgatccagctgtcccggaagaccttcgacacggagtaccagaagaccaagaacaacgactgggactacgtcgtgaccaccgacatcagcgagatgggcgccaacttccgcgccgaccgggtgatcgacccgcgccggtgcctcaagcccgtcatcctgaaggacgggcccgagcgcgtgatcctggccggccccatgccggtgacggtcgcctccgcggcccagcggcgcgggcggatcggccgcagccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgcggccatcgacggggagtaccggctgcgcggcgaggcccggaagaccttcgtggagctgatgcgccgcggggacctccccgtctggctgagctacaaggtggccagcgagggcttccagtactccgaccgccggtggtgcttcgacggcgagcgcaacaaccaggtgctggaggagaacatggacgtcgagatctggacgaaggagggggagcggaagaagctccgcccccggtggctggacgcccgcacctacagcgaccccctggcgctccgggagttcaaggagttcgccgccggccgccggtccgtgagcggggacctgatcctggagatcggcaagctcccgcagcacctgacccagcgcgcccagaacgcgctggacaacctcgtgatgctgcacaactccgagcagggcgggcgggcctaccgccacgccatggaggagctgcccgacaccatcgagacgctcatgctgctggccctcatcgccgtcctgaccggcggggtgaccctgttcttcctcagcggccgggggctgggcaagacctccatcggcctgctctgcgtgatggcgagctccgtcctgctgtggatggccagcgtggagccccactggatcgccgcctccatcatcctcgagttcttcctgatggtgctgctcatccccgagccggaccgccagcggacgccccaggacaaccagctggcctacgtcgtgatcgggctcctgttcatgatcctgacggtggcggccaacgagatgggcctgctcgagaccaccaagaaggacctggggatcggccacgtcgccgtggggaaccaccaccacgccgccatgctggacgtggacctccaccccgcgagcgcctggaccctgtacgccgtcgccacgaccatcatcaccccgatgatgcgccacaccatcgagaacacgaccgccaacatctccctgaccgcgatcgccaaccaggccgccatcctcatgggcctggacaagggctggcccatcagcaagatggacatcggggtgcccctgctcgcgctgggctgctactcccaggtgaaccccctgaccctcacggccgccgtcctgatgctggtggcccactacgccatcatcgggccgggcctccaggcgaaggccacccgcgaggcccagaagcggaccgccgccgggatcatgaagaaccccaccgtggacggcatcgtcgcgatcgacctggaccccgtggtgtacgacgccaagttcgagaagcagctgggccagatcatgctcctgatcctgtgcacgagccagatcctcctgatgcgcaccacctgggccctgtgcgagtccatcaccctcgccacggggcccctgaccaccctgtgggagggcagcccggggaagttctggaacaccacgatcgccgtctccatggcgaacatcttccggggcagctacctcgccggcgccgggctggccttcagcctgatgaagtccctcggcgggggccgccgggggaccggcgcgcagggcgagaccctgggggagaagtggaagcgccagctgaaccagctcagcaagtccgagttcaacacctacaagcggagcggcatcatggaggtggaccgctccgaggccaaggaggggctgaagcggggcgagacgaccaagcacgccgtgagccgcgggaccgccaagctgcggtggttcgtcgagcgcaacctggtgaagcccgagggcaaggtgatcgacctcggctgcgggcggggcgggtggtcctactactgcgccggcctgaagaaggtcaccgaggtgaaggggtacacgaagggcggccccgggcacgaggagcccatcccgatggcgacctacggctggaacctggtgaagctccacagcgggaaggacgtcttcttcatcccgcccgagaagtgcgacaccctgctgtgcgacatcggcgagtccagccccaacccgaccatcgaggaggggcgcacgctccgggtgctgaagatggtggagccctggctgcgcggcaaccagttctgcatcaagatcctcaacccctacatgccctccgtcgtggagaccctggagcagatgcagcggaagcacggcgggatgctggtgcgcaacccgctcagccggaactccacccacgagatgtactgggtcagctgcggcaccgggaacatcgtgtccgccgtgaacatgaccagccgcatgctgctgaaccgcttcacgatggcccaccggaagcccacctacgagcgcgacgtcgacctcggcgccggcacccggcacgtggccgtggagcccgaggtcgcgaacctggacatcatcgggcagcgcatcgagaacatcaagcacgagcacaagtccacctggcactacgacgaggacaacccctacaagacgtgggcctaccacggcagctacgaggtgaagccgtccgggagcgccagctccatggtgaacggcgtcgtgaagctgctcaccaagccctgggacgtcatccccatggtgacccagatcgccatgaccgacacgacccccttcgggcagcagcgggtgttcaaggagaaggtcgacacccgcaccccgaaggccaagcggggcacggcgcagatcatggaggtgaccgccaagtggctgtggggcttcctgagccgcaacaagaagccccggatctgcacccgcgaggagttcacccggaaggtgcgctccaacgccgccatcggggcggtcttcgtggacgagaaccagtggaacagcgccaaggaggccgtggaggacgagcggttctgggacctcgtccaccgcgagcgggagctgcacaagcagggcaagtgcgccacgtgcgtgtacaacatgatggggaagcgcgagaagaagctgggcgagttcgggaaggccaagggctcccgggcgatctggtacatgtggctcggcgcccgcttcctggagttcgaggccctggggttcatgaacgaggaccactggttcagccgggagaactccctcagcggcgtggagggggagggcctgcacaagctggggtacatcctccgcgacatctccaagatccccggcggcaacatgtacgccgacgacaccgccgggtgggacacccggatcaccgaggacgacctgcagaacgaggcgcgcatcacggacatcatggagccggagcacgccctgctcgccaagagcatcttcaagctgacctaccagaacaaggtcgtgcgcgtgcagcggcccgccaagaacggcaccgtcatggacgtgatctcccgccgggaccagcgcgggagcggccaggtgggcacctacgggctgaacacgttcaccaacatggaggcccagctcatccggcagatggagtccgagggcatcttcagcccctccgagctggagacccccaacctggcggagcgcgtcctcgtgtggctggagaagtacggggtggagcggctgaagcgcatggccatcagcggcgacgactgcgtcgtgaagccgatcgacgaccggttcgccaccgccctcacggccctgaacgacatggggaaggtgcgcaaggacatcccccagtgggagccctccaagggctggaacgactggcagcaggtccccttctgcagccaccacttccaccagctgatcatgaaggacggccgggagatcgtggtgccgtgccgcaaccaggacgagctcgtcgggcgggcgcgcgtgagccagggcgccgggtggtccctgcgggagaccgcctgcctgggcaagagctacgcccagatgtggcagctcatgtacttccaccgccgggacctgcgcctggcggccaacgccatctgctccgccgtgcccgtcgactggatccccaccagccggaccacgtggtccatccacgcccaccaccagtggatgaccaccgaggacatgctcagcgtgtggaaccgcgtgtggatcgaggagaacccctggatggaggacaagacccacatctccagctggggcgacgtcccgtacctgggcaagcgcgaggaccagtggtgcggctccctgatcgggctcacggcgcgggccacctgggccaccaacatccaggtggccatcaaccaggtgcgccggctgatcggcaacgagaactacctggactacatgaccagcatgaagcgcttcaagaacgagtccgaccccgagggggccctctggtga

SEQ ID NO: 7992 - RNA, 9879 nt, synthetic construct
  misc_feature 1..9879: note = derived and/or modified CDS sequence (opt1) from DENV-1__GU131894__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctgcgggacagctacacccaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggccgtgttcctgctcctgatcatggggcagctgacgtggaacgacctcatccgcctgtgcatcatggtgggcgcgaacgccagcgaccgcatggggatgggcaccacctacctggccctcatggccaccttcaagatgcggccgatgttcgccgtcgggctgctgttccgccggctcacgtcccgcgaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcgtgctacgtgatcagcgggtccagcgccgacctctccctggagaaggccgccgaggtcagctgggaggaggaggccgagcactccggcgcgagccacaacatcctggtggaggtgcaggacgacgggaccatgaagatcaaggacgaggagcgggacgacaccctcaccatcctgctgaaggccaccctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacccggggcgcggtgctgatgtaccaggggaagcgcctggagcccagctgggcctccgtcaagaaggacctcatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgcgaggggaagatcgtgggcctctacggcaacggggtggtcaccaccagcggcacctacgtgagcgccatcgcccaggccaaggcgtcccaggaggggccgctgcccgagatcgaggacgaggtgttccggaagcgcaacctgacgatcatggacctccaccccggcagcgggaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctcaaggacgggcccgagcgcgtgatcctggccggccccatgccggtcacggtggcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggacgaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtcatgctccacaacagcgagcagggcgggcgggcgtaccgccacgccatggaggagctgcccgacaccatcgagacgctgatgctcctggccctgatcgccgtgctcaccggcggggtgaccctgttcttcctgtccggccgggggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccgccagcggacgccccaggacaaccagctcgcctacgtggtgatcgggctgctgttcatgatcctcacggtcgccgcgaacgagatgggcctgctggagaccaccaagaaggacctcgggatcggccacgtggccgtggggaaccaccaccacgccgccatgctggacgtcgacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtgcccctgctggccctcggctgctacagccaggtcaaccccctgaccctgacggcggccgtgctcatgctggtggcccactacgccatcatcgggccgggcctgcaggccaaggcgacccgcgaggcccagaagcggaccgccgccgggatcatgaagaaccccaccgtcgacggcatcgtggccatcgacctcgaccccgtggtctacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtggaccgcagcgaggcgaaggaggggctcaagcggggcgagacgaccaagcacgccgtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacacgaagggcggccccgggcacgaggagcccatcccgatggccacctacggctggaacctggtcaagctgcactccgggaaggacgtgttcttcatcccgcccgagaagtgcgacaccctcctgtgcgacatcggcgagagctcccccaacccgaccatcgaggaggggcgcacgctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccggaacagcacccacgagatgtactgggtgtcctgcggcaccgggaacatcgtgagcgcggtcaacatgacctcccgcatgctcctgaaccgcttcacgatggcccaccggaagcccacctacgagcgcgacgtggacctgggcgccggcacccggcacgtggccgtcgagcccgaggtggccaacctcgacatcatcgggcagcgcatcgagaacatcaagcacgagcacaagagcacctggcactacgacgaggacaacccctacaagacgtgggcgtaccacggctcctacgaggtgaagccgagcgggtccgccagcagcatggtcaacggcgtggtcaagctgctgaccaagccctgggacgtgatccccatggtgacccagatcgccatgaccgacacgacccccttcgggcagcagcgggtcttcaaggagaaggtggacacccgcaccccgaaggccaagcggggcacggcccagatcatggaggtgaccgcgaagtggctctggggcttcctgtcccgcaacaagaagccccggatctgcacccgcgaggagttcacccggaaggtccgcagcaacgccgccatcggggccgtgttcgtggacgagaaccagtggaactccgcgaaggaggccgtcgaggacgagcggttctgggacctggtgcacaaggagcgcgagctccacaagcagggcaagtgcgccacgtgcgtgtacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgccgacgacaccgccgggtgggacacccgcatcaccgaggacgacctccagaacgaggcccggatcacggacatcatggagccggagcacgcgctgctggccaagtccatcttcaagctcacctaccagaacaaggtggtgcgcgtccagcgccccgccaagaacggcaccgtgatggacgtgatcagccggcgcgaccagcgggggtccggccaggtcggcacctacgggctgaacacgttcaccaacatggaggcccagctgatccgccagatggagagcgagggcatcttctcccccagcgagctcgagacccccaacctggccgagcgggtgctggactggctcgagaagtacggggtggagcgcctgaagcggatggcgatctccggcgacgactgcgtcgtgaagccgatcgacgaccgcttcgccaccgccctgacggccctcaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctggtcgggcgcgcccgggtgagccagggcgcggggtggagcctccgcgagaccgcctgcctgggcaagtcctacgcccagatgtggcagctgatgtacttccaccggcgcgacctccggctggccgcgaacgccatctgcagcgccgtgcccgtcgactggacccccacctcccgcacgacctggagcatccacgcccaccaccagtggatgaccaccgaggacatgctgtccgtgtggaaccgggtgtggatcgaggagaacccctggatggaggacaagacgcacatcagctcctggggcgacgtcccgtacctcggcaagcgcgaggaccagtggtgcggcagcctgatcgggctgaccgcccgcgcgacctgggccaccaacatccaggtggccatcaaccaggtgcggcgcctcatcggcaacgagaactacctggactacatgacctccatgaagcggttcaagaacgagagcgaccccgagggggccctgtggtga

SEQ ID NO: 7993 - RNA, 9879 nt, synthetic construct
  misc_feature 1..9879: note = derived and/or modified CDS sequence (opt1) from DENV-1__GU131895__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctggcgctgaagggcatgagctacgtgatgtgcaccgggtccttcaagctcgagaaggaggtcgccgagacccagcacggcacggtgctggtgcagatcaagtacgagggcaccgacgccccctgcaagatccccttcagcacccaggacgagaagggggtcacccagaacggccggctgatcacggccaacccgatcgtgaccgacaaggagaagcccgtgaacatcgaggcggagccgcccttcggggagtcctacatcgtcatcggcgccggcgagaaggccctgaagctcagctggttcaagaaggggtccagcatcggcaagatgttcgaggccaccgcccgcggggcgcggcgcatggccatcctgggcgacaccgcctgggacttcgggtccatcggcggcgtgttcacgagcgtggggaagctggtccaccagatcttcggcaccgcctacggggtcctcttctccggcgtgagctggaccatgaagatcgggatcggcgtcctgctgacctggctcggcctgaactcccgcagcacgtccctgagcatgacctgcatcgccgtggggctcgtgaccctgtacctgggcgtcatggtgcaggcggactccgggtgcgtgatcaactggaagggccgggagctcaagtgcgggagcggcatcttcgtcaccaacgaggtgcacacgtggaccgagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagttcaccgtcgtggtgggggacgtcgccggcatcctcgcccaggggaagaagatgatccggccccagcccatggagtacaagtacagctggaagtcctggggcaaggccaagatcatcggcgcggacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggtctgcgaccaccgcctcatgtccgccgccatcaaggacagcaaggccgtgcacgcggacatgggctactggatcgagtccgagaagaacgagacctggaagctggcccgggccagcttcatcgaggtgaagacctgcatctggcccaagtcccacaccctgtggagcaacggcgtcctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggcggtgttcctgctcctgatcatggggcagctgacctggaacgacctcatccgcctgtgcatcatggtgggcgccaacgccagcgaccgcatggggatgggcacgacctacctggccctcatggccaccttcaagatgcggccgatgttcgcggtcgggctgctgttccgccggctcacctcccgcgaggtgctgctgctcacgatcgggctgagcctggtggcctccgtcgagctccccaacagcctggaggagctgggcgacgggctcgccatgggcatcatgatcctgaagctgctcaccgacttccagtcccaccagctgtgggccaccctgctcagcctgaccttcatcaagacgaccttctccctgcactacgcgtggaagaccatggccatggtgctcagcatcgtctccctgttccccctgtgcctcagcaccacgtcccagaagaccacctggctgcccgtgctgctcggcagcctggggtgcaagccgctgaccatgttcctcatcgccgagaacaagatctggggccggcgctcctggcccctgaacgaggggatcatggccgtgggcatcgtcagcatcctgctcagctccctgctgaagaacgacgtgcccctcgccgggcccctgatcgcgggcggcatgctgatcgcctgctacgtgatcagcgggtccagcgccgacctctccctggagaaggccgccgaggtcagctgggaggaggaggcggagcactccggcgccagccacaacatcctggtggaggtgcaggacgacgggacgatgaagatcaaggacgaggagcgggacgacaccctcaccatcctgctgaaggccaccctcctggccgtctccggcgtgtacccgctgagcatccccgccaccctcttcgtgtggtacttctggcagaagaagaagcagcgctccggggtcctgtgggacacgcccagcccgcccgaggtggagcgggcggtgctggacgacggcatctaccgcatcatgcagcggggcctgctcgggcgctcccaggtcggcgtgggggtgttccaggagaacgtcttccacaccatgtggcacgtgacccggggcgccgtgctgatgtaccaggggaagcgcctggagcccagctgggcctccgtcaagaaggacctcatcagctacggcggcgggtggcggctgcagggctcctggaacaccggggaggaggtccaggtgatcgccgtcgagcccggcaagaaccccaagaacgtgcagacggcccccgggaccttcaagacccccgagggcgaggtgggcgcgatcgccctggacttcaagcccgggaccagcggctcccccatcgtcaaccgcgaggggaagatcgtgggcctctacggcaacggggtggtcacgaccagcggcacctacgtgagcgccatcgcccaggcgaaggcctcccaggaggggccgctgcccgagatcgaggacgaggtgttccggaagcgcaacctgaccatcatggacctccaccccggcagcgggaagacgcggcgctacctgccggccatcgtccgggaggccatcaagcgcaagctgcgcaccctcatcctggcccccacccgggtggtggcgtccgagatggccgaggccctgaagggcatgcccatccgctaccagaccacggccgtcaagagcgagcacaccggcaaggagatcgtggacctcatgtgccacgccaccttcaccatgcggctgctgtcccccgtgcgcgtcccgaactacaacatgatcatcatggacgaggcgcacttcacggaccccagctccatcgccgcccgggggtacatcagcacccgcgtgggcatgggggaggccgccgcgatcttcatgaccgccacgccgcccggctccgtggaggccttcccgcagagcaacgccgtcatccaggacgaggagcgggacatccccgagcgctcctggaacagcgggtacgagtggatcacggacttccccggcaagaccgtgtggttcgtgccctccatcaagagcggcaacgacatcgcgaactgcctccggaagaacgggaagcgcgtcatccagctgtcccggaagaccttcgacaccgagtaccagaagacgaagaacaacgactgggactacgtggtgaccaccgacatcagcgagatgggcgccaacttccgcgccgaccgggtcatcgacccgcgccggtgcctgaagcccgtgatcctcaaggacgggcccgagcgcgtgatcctggccggccccatgccggtcaccgtggcctccgcggcccagcggcgcgggcggatcggccgcaaccacaacaaggagggcgaccagtacatctacatggggcagcccctgaacaacgacgaggaccacgcccactggacggaggccaagatgctcctggacaacatcaacacccccgagggcatcatccccgccctgttcgagccggagcgcgagaagtccgcggccatcgacggggagtaccggctccgcggcgaggcccggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacgtactccgaccccctggcgctgcgggagttcaaggagttcgccgccggccgccggagcgtgtccggggacctcatcctggagatcggcaagctgccgcagcacctcacccagcgcgcccagaacgcgctggacaacctggtcatgctccacaacagcgagcagggcgggcgggcctaccgccacgccatggaggagctgcccgacaccatcgagaccctgatgctcctggccctgatcgccgtgctcacgggcggggtgaccctgttcttcctgtccggccgggggctcggcaagaccagcatcggcctgctgtgcgtcatggcgtccagcgtgctcctgtggatggcctccgtggagccccactggatcgccgccagcatcatcctggagttcttcctcatggtcctgctgatccccgagccggaccgccagcggacgccccaggacaaccagctcgcctacgtggtgatcgggctgctgttcatgatcctcaccgtcgcggccaacgagatgggcctgctggagacgaccaagaaggacctcgggatcggccacgtggccgtggggaaccaccaccacgccgccatgctggacgtcgacctgcaccccgcgtccgcctggaccctctacgccgtggccaccacgatcatcaccccgatgatgcgccacaccatcgagaacaccacggccaacatcagcctgaccgcgatcgccaaccaggccgccatcctgatgggcctcgacaagggctggcccatctccaagatggacatcggggtgcccctgctggcgctcggctgctacagccaggtcaaccccctgaccctgaccgccgccgtgctcatgctggtggcccactacgccatcatcgggccgggcctgcaggcgaaggccacgcgcgaggcccagaagcggaccgccgccgggatcatgaagaaccccaccgtcgacggcatcgtggcgatcgacctcgaccccgtggtctacgacgccaagttcgagaagcagctgggccagatcatgctgctcatcctgtgcacctcccagatcctgctcatgcgcacgacctgggccctgtgcgagagcatcaccctggccaccgggcccctcacgaccctgtgggagggctccccggggaagttctggaacaccaccatcgccgtgagcatggcgaacatcttccggggctcctacctggccggcgccgggctcgccttcagcctgatgaagtccctgggcgggggccgccgggggacgggcgcgcagggcgagaccctcggggagaagtggaagcgccagctgaaccagctgtccaagagcgagttcaacacctacaagcggtccggcatcatggaggtggaccgcagcgaggccaaggaggggctcaagcggggcgagaccacgaagcacgccgtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacaccaagggcggccccgggcacgaggagcccatcccgatggcgacgtacggctggaacctggtcaagctgcactccgggaaggacgtgttcttcatcccgcccgagaagtgcgacaccctcctgtgcgacatcggcgagagctcccccaacccgaccatcgaggaggggcgcaccctgcgggtgctcaagatggtcgagccctggctgcgcggcaaccagttctgcatcaagatcctgaacccctacatgcccagcgtggtggagacgctcgagcagatgcagcggaagcacggcgggatgctggtccgcaacccgctgtcccggaacagcacccacgagatgtactgggtgtcctgcggcaccgggaacatcgtgagcgccgtcaacatgacctcccgcatgctcctgaaccgcttcaccatggcccaccggaagcccacgtacgagcgcgacgtggacctgggcgccggcacccggcacgtggccgtcgagcccgaggtggcgaacctcgacatcatcgggcagcgcatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctgctgacgaagccctgggacgtgatccccatggtgacccagatcgccatgaccgacaccacgcccttcgggcagcagcgggtcttcaaggagaaggtggacacccgcaccccgaaggccaagcggggcaccgcgcagatcatggaggtgacggccaagtggctctggggcttcctgtcccgcaacaagaagccccggatctgcacccgcgaggagttcacccggaaggtccgcagcaacgccgccatcggggcggtgttcgtggacgagaaccagtggaactccgccaaggaggccgtcgaggacgagcggttctgggacctggtgcacaaggagcgcgagctccacaagcagggcaagtgcgcgacctgcgtgtacaacatgatggggaagcgggagaagaagctgggcgagttcgggaaggccaagggcagccgcgcgatctggtacatgtggctgggcgcccggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgccgacgacacggccgggtgggacacccgcatcaccgaggacgacctccagaacgaggcgcggatcaccgacatcatggagccggagcacgccctgctggccaagtccatcttcaagctcacgtaccagaacaaggtggtgcgcgtccagcgccccgccaagaacggcaccgtgatggacgtgatcagccggcgcgaccagcgggggtccggccaggtcggcacctacgggctgaacaccttcacgaacatggaggcccagctgatccgccagatggagagcgagggcatcttctcccccagcgagctcgagacccccaacctggcggagcgggtgctggactggctcgagaagtacggggtggagcgcctgaagcggatggccatctccggcgacgactgcgtcgtgaagccgatcgacgaccgcttcgccaccgccctgaccgccctcaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctggtcgggcgcgcgcgggtgagccagggcgccgggtggagcctccgcgagacggcctgcctgggcaagtcctacgcccagatgtggcagctgatgtacttccaccggcgcgacctccggctggcggccaacgccatctgcagcgccgtgcccgtcgactggatccccacctcccgcaccacctggagcatccacgcccaccaccagtggatgacgaccgaggacatgctgtccgtgtggaaccgggtgtggatcgaggagaacccctggatggaggacaagacccacatcagctcctggggcgacgtcccgtacctcggcaagcgcgaggaccagtggtgcggcagcctgatcgggctgaccgcgcgcgccacgtgggccaccaacatccaggtggccatcaaccaggtgcggcgcctcatcggcaacgagaactacctggactacatgacctccatgaagcggttcaagaacgagagcgaccccgagggggccctgtggtga

SEQ ID NO: 7994 - RNA, 9879 nt, synthetic construct
  misc_feature 1..9879: note = derived and/or modified CDS sequence (opt1) from DENV-1__GQ868632__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcgtgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgagcagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagcgggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcctgctcctgatcatggggcagctgacgtggaacgacctcatccgcctgtgcatcatggtcggcgcgaacgccagcgaccggatggggatgggcaccacctacctggccctcatggccaccttcaagatgcgcccgatgttcgccgtggggctgctgttccggcgcctcacgtcccgggaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtcctcagcatcgtgtccctgttccccctgtgcctcagcacgacctcccagaagaccacctggctgcccgtgctgctcggcagcctggggtgcaagccgctgacgatgttcctcatcgccgagaacaagatctggggccgccggtcctggcccctgaacgaggggatcatggccgtcggcatcgtgagcatcctgctcagctccttcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctgtacggcaacggggtcgtgaccaccagcggcacctacgtgagcgccatcgcccaggccaaggcgtcccaggaggggccgctccccgagatcgaggacgaggtcttccgcaagcggaacctgacgatcatggacctgcaccccggcagcgggaagacccgccggtacctcccggccatcgtgcgcgaggccatcaagcgcaagctgcggaccctgatcctcgcccccacccgcgtggtcgcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcatcctcgccggccccatgccggtgacggtcgcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagacgctgatgctgctcgccctgatcgccgtgctgaccggcggggtcaccctcttcttcctgtccggccgcgggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccggcagcgcacgccccaggacaaccagctggcctacgtggtcatcgggctcctgttcatgatcctgacggtggccgcgaacgagatgggcctcctggagaccaccaagaaggacctggggatcggccacgtggccgtcgggaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatgggcctggacaagggctggcccatctccaagatggacatcggggtccccctcctggccctgggctgctacagccaggtgaaccccctcaccctgacggcggccgtgctgatgctcgtcgcccactacgccatcatcgggccgggcctgcaggccaaggcgacccgggaggcccagaagcgcaccgccgccgggatcatgaagaaccccaccgtggacggcatcgtggccatcgacctggaccccgtcgtgtacgacgcgaagttcgagaagcagctcggccagatcatgctgctgatcctctgcacgtcccagatcctgctgatgcggaccacctgggccctctgcgagagcatcaccctggccacggggcccctgaccaccctctgggagggctccccggggaagttctggaacaccacgatcgccgtgagcatggccaacatcttccgcggctcctacctggcgggcgccgggctggccttcagcctcatgaagtccctgggcgggggccggcgcgggaccggcgcccagggcgagaccctgggggagaagtggaagcggcagctcaaccagctgtccaagagcgagttcaacacctacaagcgctccggcatcatggaggtcgaccggagcgaggcgaaggaggggctgaagcgcggcgagacgaccaagcacgccgtgtcccgggggaccgccaagctccgctggttcgtggagcggaacctggtcaagcccgagggcaaggtgatcgacctgggctgcgggcgcggcgggtggagctactactgcgccggcctgaagaaggtgaccgaggtcaaggggtacacgaagggcggccccgggcacgaggagcccatcccgatggccacctacggctggaacctcgtgaagctgcactccgggaaggacgtgttcttcatcccgcccgagaagtgcgacaccctgctctgcgacatcggcgagagctcccccaacccgaccatcgaggaggggcggacgctgcgcgtcctgaagatggtggagccctggctccggggcaaccagttctgcatcaagatcctgaacccctacatgcccagcgtggtcgagaccctggagcagatgcagcgcaagcacggcgggatgctcgtgcggaacccgctgtcccgcaacagcacccacgagatgtactgggtgtcctgcggcaccgggaacatcgtcagcgcggtgaacatgacctcccgcatgctgctcaaccggttcacgatggcccaccgcaagcccacctacgagcgggacgtggacctgggcgccggcacccgccacgtcgccgtggagcccgaggtggccaacctggacatcatcgggcagcggatcgagaacatcaagcacgagcacaagagcacctggcactacgacgaggacaacccctacaagacgtgggcgtaccacggctcctacgaggtcaagccgagcgggtccgccagcagcatggtgaacggcgtcgtgaagctcctgaccaagccctgggacgtgatccccatggtcacccagatcgccatgaccgacacgacccccttcgggcagcagcgcgtgttcaaggagaaggtggacacccggaccccgaaggccaagcgcggcacggcccagatcatggaggtcaccgcgaagtggctgtggggcttcctctcccggaacaagaagccccgcatctgcacccgggaggagttcacccgcaaggtgcggagcaacgccgccatcggggccgtgttcgtcgacgagaaccagtggaactccgcgaaggaggccgtggaggacgagcgcttctgggacctggtgcacaaggagcgggagctgcacaagcagggcaagtgcgccacgtgcgtctacaacatgatggggaagcgcgagaagaagctcggcgagttcgggaaggccaagggcagccgggccatctggtacatgtggctgggcgcgcgcttcctggagttcgaggccctcgggttcatgaacgaggaccactggttctcccgggagaacagcctgtccggcgtggagggggagggcctgcacaagctcgggtacatcctgcgcgacatcagcaagatccccggcggcaacatgtacgccgacgacaccgccgggtgggacacccggatcaccgaggacgacctgcagaacgaggcccgcatcacggacatcatggagccggagcacgcgctcctggccaagtccatcttcaagctgacctaccagaacaaggtggtccgcgtgcagcggcccgccaagaacggcaccgtgatggacgtcatcagccgccgggaccagcgcgggtccggccaggtgggcacctacgggctcaacacgttcaccaacatggaggcccagctgatccggcagatggagagcgagggcatcttctcccccagcgagctggagacccccaacctcgccgagcgcgtgctggactggctggagaagtacggggtcgagcggctcaagcgcatggcgatctccggcgacgactgcgtggtgaagccgatcgacgaccggttcgccaccgccctgacggccctgaacgacatggggaaggtccgcaaggacatcccccagtgggagcccagcaagggctggaacgactggcagcaggtccccttctgctcccaccacttccaccagctcatcatgaaggacggccgggagatcgtggtcccgtgccgcaaccaggacgagctggtggggcgggcccgcgtgagccagggcgcggggtggagcctgcgggagaccgcctgcctcggcaagtcctacgcccagatgtggcagctgatgtacttccaccgccgggacctgcgcctcgccgcgaacgccatctgcagcgccgtccccgtggactggatccccacctcccggaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctgggcaagcgcgaggaccagtggtgcggcagcctcatcgggctgacggcccgggcgacctgggccaccaacatccaggtggccatcaaccaggtccgccggctgatcggcaacgagaactacctcgactacatgacctccatgaagcgcttcaagaacgagagcgaccccgagggggccctgtggtga

SEQ ID NO: 7995 - RNA, 9879 nt, synthetic construct
  misc_feature 1..9879: note = derived and/or modified CDS sequence (opt1) from DENV-1__GQ868633__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctgcgggacagctacacccaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggccgtgttcctgctcctgatcatggggcagctgacgtggaacgacctcatccgcctgtgcatcatggtgggcgcgaacgccagcgaccgcatggggatgggcaccacctacctggccctcatggccaccttcaagatgcggccgatgttcgccgtcgggctgctgttccgccggctcacgtcccgcgaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcgtgctacgtgatcagcgggtccagcgccgacctctccctggagaaggccgccgaggtcagctgggaggaggaggccgagcactccggcgcgagccacaacatcctggtggaggtgcaggacgacgggaccatgaagatcaaggacgaggagcgggacgacaccctcaccatcctgctgaaggccaccctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacccggggcgcggtgctgatgtaccaggggaagcgcctggagcccagctgggcctccgtcaagaaggacctcatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgcgaggggaagatcgtgggcctctacggcaacggggtggtcaccaccagcggcacctacgtgagcgccatcgcccaggccaaggcgtcccaggaggggccgctgcccgagatcgaggacgaggtgttccggaagcgcaacctgacgatcatggacctccaccccggcagcgggaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctcaaggacgggcccgagcgcgtgatcctggccggccccatgccggtcacggtggcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggacgaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtcatgctccacaacagcgagcagggcgggcgggcgtaccgccacgccatggaggagctgcccgacaccatcgagacgctgatgctcctggccctgatcgccgtgctcaccggcggggtgaccctgttcttcctgtccggccgggggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccgccagcggacgccccaggacaaccagctcgcctacgtggtgatcgggctgctgttcatgatcctcacggtcgccgcgaacgagatgggcctgctggagaccaccaagaaggacctcgggatcggccacgtggccgtggggaaccaccaccacgccgccatgctggacgtcgacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtgcccctgctggccctcggctgctacagccaggtcaaccccctgaccctgacggcggccgtgctcatgctggtggcccactacgccatcatcgggccgggcctgcaggccaaggcgacccgcgaggcccagaagcggaccgccgccgggatcatgaagaaccccaccgtcgacggcatcgtggccatcgacctcgaccccgtggtctacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtggaccgcagcgaggcgaaggaggggctcaagcggggcgaggccacgaagcacgccgtctcccgcgggcccgccaagctgcggtggttcgtggagcgcaacctggtgaaccccgagggcaaggtcatcgacctgggctgcgggcggggcgggtggagctactactgcgccggcctcaagaaggtgaccgaggtgaaggggtacaccaagggcggccccgggcacgaggagccgatccccatggcgacctacggctggaacctggtcaagctgcactccgggaaggacgtgttcttcatcccgcccgagaagtgcgacacgctcctgtgcgacatcggcgagagctccccgaaccccaccatcgaggaggggcgcaccctgcgggtgctcaagatggtcgagccctggctgcgcggcaaccagttctgcatcaagatcctgaacccctacatgccgagcgtggtggagaccctcgagcagatgcagcggaagcacggcgggatgctggtccgcaaccccctgtcccggaacagcacgcacgagatgtactgggtgtcctgcggcaccgggaacatcgtgagcgccgtcaacatgacctcccgcatgctcctgaaccgcttcaccatggcccaccggaagcccacctacgagcgcgacgtggacctgggcgccggcacgcggcacgtggccgtcgagcccgaggtggcgaacctcgacatcatcgggcagcgcatcgagaacatcaagcacgagcacaagagcacctggcactacgacgaggacaacccgtacaagacctgggcctaccacggctcctacgaggtgaagcccagcgggtccgccagcagcatggtcaacggcgtggtcaagctgctgaccaagccctgggacgtgatccccatggtgacgcagatcgccatgaccgacaccaccccgttcgggcagcagcgggtcttcaaggagaaggtggacacgcgcacccccaaggccaagcggggcaccgcgcagatcatggaggtgaccgccaagtggctctggggcttcctgtcccgcaacaagaagccccggatctgcacgcgcgaggagttcacccggaaggtccgcagcaacgccgccatcggggcggtgttcgtggacgagaaccagtggaactccgccaaggaggccgtcgaggacgagcggttctgggacctggtgcacaaggagcgcgagctccacaagcagggcaagtgcgcgacctgcgtgtacaacatgatggggaagcgggagaagaagctgggcgagttcgggaaggccaagggcagccgcgcgatctggtacatgtggctgggcgcccggttcctcgagttcgaggccctggggttcatgaacgaggaccactgggtctcccgcgagaacagcctgtccggcgtggagggggagggcctccacaagctggggtacatcctgcgggacatcagcaagatcccgggcggcaacatgtacgccgacgacaccgccgggtgggacacgcgcatcaccgaggacgacctccagaacgaggcgcggatcaccgacatcatggagcccgagcacgccctgctggccaagtccatcttcaagctcacctaccagaacaaggtggtccgcgtgcagcgccccgccaagaacggcacggtgatggacgtcatcagccggcgcgaccagcgggggtccggccaggtgggcacctacgggctgaacaccttcaccaacatggaggcccagctgatccgccagatggagagcgagggcatcttctcccccagcgagctcgagacgccgaacctggcggagcgggtgctggactggctcgagaagtacggggtcgagcgcctgaagcggatggccatctccggcgacgactgcgtggtgaagcccatcgacgaccgcttcgccaccgccctgaccgccctcaacgacatggggaaggtccggaaggacatcccccagtgggagcccagcaagggctggaacgactggcagcaggtcccgttctggtcccaccacttccaccagctgatcatgaaggacggccgcgagatcgtggtcccctgccggaaccaggacgagctggtggggcgcgcgcgggtgagccagggcgccgggtggagcctccgcgagaccgcctgcctgggcaagtcctacgcccagatgtggcagctgatgtacttccaccggcgcgacctccggctggcggccaacgccatctgcagcgccgtccccgtggactggatccccacgtcccgcaccacctggagcatccacgcccaccaccagtggatgaccacggaggacatgctgtccgtgtggaaccgggtctggatcgaggagaacccgtggatggaggacaagacccacatcagctcctggggcgacgtgccctacctcggcaagcgcgaggaccagtggtgcggcagcctgatcgggctgaccgcgcgcgccacctgggccacgaacatccaggtggccatcaaccaggtccggcgcctcatcggcaacgagaactacctggactacatgacctccatgaagcggttcaagaacgagagcgaccccgagggggccctgtggtga

SEQ ID NO: 7996 - RNA, 9879 nt, synthetic construct
  misc_feature 1..9879: note = derived and/or modified CDS sequence (opt1) from DENV-1__GU131919__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcctgacccaggacgagaagggggtcacgcagaacggccggctgatcaccgccaacccgatcgtgaccgacaaggagaagcccgtgaacatcgaggccgagccgcccttcggggagagctacatcgtcatcggcgcgggcgagaaggccctcaagctgtcctggttcaagaaggggagctccatcggcaagatgttcgaggccaccgcccgcggggcccggcgcatggcgatcctgggcgacacggcctgggacttcgggagcatcggcggcgtgttcacctccgtggggaagctcatccaccagatcttcggcaccgcctacggggtcctgttcagcggcgtgtcctggaccatgaagatcgggatcggcgtgctgctcacgtggctgggcctgaacagccgctccaccagcctctccatgacctgcatcgccgtcgggctggtgaccctgtacctcggcgtgatggtccaggccgacagcgggtgcgtgatcaactggaagggccgggagctgaagtgcgggtccggcatcttcgtgacgaacgaggtccacacctggaccgagcagtacaagttccaggcggacagcccgaagcgcctgagcgccgccatcggcaaggcctgggaggagggggtgtgcggcatccggtccgccacccgcctcgagaacatcatgtggaagcagatcagcaacgagctgaaccacatcctgctcgagaacgacatgaagttcaccgtggtcgtgggggacgtggcgggcatcctggcccaggggaagaagatgatccggccccagcccatggagtacaagtactcctggaagtcctggggcaaggccaagatcatcggcgccgacgtccagaacacgaccttcatcatcgacgggcccaacaccccggagtgccccgacgaccagcgcgcgtggaacatctgggaggtggaggactacggcttcgggatcttcaccacgaacatctggctgaagctccgggactcctacacccaggtgtgcgaccaccgcctgatgagcgccgccatcaaggactccaaggccgtccacgccgacatgggctactggatcgagagcgagaagaacgagacctggaagctggcgcgggcctccttcatcgaggtgaagacctgcatctggcccaagagccacacgctctggtccaacggcgtgctggagagcgagatgatcatccccaagatctacgggggcccgatctcccagcacaactaccgccccgggtacttcacccagaccgccggcccctggcacctggggaagctcgagctggacttcgacctgtgcgagggcaccacggtcgtggtggacgagcactgcggcaaccgggggccgagcctccgcaccaccaccgtcacgggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtctccgccggcagcggcgaggtggacagcttctccctggggctgctctgcatcagcatcatgatcgaggaggtgatgcggtcccgctggagccggaagatgctgatgaccggcaccctggccgtcttcctcctgctgatcatggggcagctcacgtggaacgacctgatccgcctgtgcatcatggtgggcgcgaacgcctgcgaccgcatggggatgggcaccacctacctcgccctgatggccaccttcaagatgcggccgatgttcgccgtggggctcctgttccgccggctgacgtcccgcgaggtcctgctcctgaccatcgggctgagcctcgtggcgtccgtggagctgcccaacagcctggaggagctcggcgacgggctggccatgggcatcatgatcctgaagctcctgaccgacttccagtcctaccagctgtgggccaccctcctgagcctgacgttcatcaagaccaccttctccctccactacgcctggaagaccatggcgatggtcctgagcatcgtgtccctgttccccctctgcctgagcacgacctcccagaagaccacctggctgcccgtcctcctgggcagcctggggtgcaagccgctcacgatgttcctgatcgccgagaacaagatctggggccggcgctcctggcccctgaacgaggggatcatggccgtgggcatcgtgagcatcctcctgtccagcctgctcaagaacgacgtccccctggccgggcccctgatcgccggcggcatgctcatcgcgtgctacgtgatcagcgggtccagcgccgacctgtccctggagaaggccgccgaggtgagctgggaggaggaggccgagcactccggcgcgagccacaacatcctcgtcgaggtgcaggacgacgggaccatgaagatcaaggacgaggagcgggacgacaccctgaccatcctgctcaaggccaccctgctggccgtgtccggcgtctacccgctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgcggtgctgatgtaccaggggaagcgcctcgagcccagctgggcctccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgcgctcgacttcaagcccgggacgagcggctcccccatcgtgaaccgcgaggggaagatcgtcggcctgtacggcaacggggtggtgaccaccagcggcacctacgtctccgccatcgcccaggccaaggcgagccaggaggggccgctgcccgagatcgaggacgaggtgttccggaagcgcaacctcacgatcatggacctgcaccccggcagcgggaagacccggcgctacctgccggccatcgtgcgggaggccatcaagcgcaagctccgcaccctgatcctggcccccacccgggtcgtggcctccgagatggcggaggccctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcccacttcaccgaccccagctccatcgcggcccgggggtacatcagcacccgcgtcggcatgggggaggccgccgccatcttcatgaccgcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgcgaacttccgcgccgaccgggtgatcgacccgcgccggtgcctcaagcccgtcatcctgaaggacgggcccgagcgcgtgatcctggccggccccatgccggtgacggtcgcctccgccgcgcagcggcgcgggcggatcggccgcaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgccgcgatcgacggggagtaccggctgcgcggcgaggcccggaagaccttcgtggagctgatgcgccgcggggacctccccgtctggctgtcctacaaggtggccagcgagggcttccagtactccgaccgccggtggtgcttcgacggcgagcgcaacaaccaggtgctggaggagaacatggacgtcgagatctggacgaaggagggggagcggaagaagctccgcccccggtggctggacgcccgcacctacagcgaccccctggccctccgggagttcaaggagttcgcggccggccgccggagcgtgtccggggacctgatcctggagatcggcaagctcccgcagcacctgacccagcgcgcccagaacgccctggacaacctcgtgatgctgcacaacagcgagcagggcgggcgggcgtaccgccacgccatggaggagctgcccgacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcgtccgtggagccccactggatcgccgccagcatcatcctcgagttcttcctgatggtgctgctcatccccgagccggaccgccagcggacgccccaggacaaccagctggcctacgtcgtgatcgggctcctgttcatgatcctgacggtggccgcgaacgagatgggcctgctcgagaccaccaagaaggacctggggatcggccacgtcgccgtggggaaccaccaccacgccgccatgctggacgtggacctccaccccgcctccgcgtggaccctgtacgccgtcgccacgaccatcatcaccccgatgatgcgccacaccatcgagaacacgaccgccaacatcagcctgaccgccatcgcgaaccaggccgccatcctcatgggcctggacaagggctggcccatctccaagatggacatcggggtgcccctgctcgccctgggctgctacagccaggtgaaccccctgaccctcacggcggccgtcctgatgctggtggcccactacgccatcatcgggccgggcctccaggccaaggcgacccgcgaggcccagaagcggaccgccgccgggatcatgaagaaccccaccgtggacggcatcgtcgccatcgacctggaccccgtggtgtacgacgcgaagttcgagaagcagctgggccagatcatgctcctgatcctgtgcacgtcccagatcctcctgatgcgcaccacctgggccctgtgcgagagcatcaccctcgccacggggcccctgaccaccctgtgggagggctccccggggaagttctggaacaccacgatcgccgtcagcatggccaacatcttccggggctcctacctcgcgggcgccgggctggccttcagcctgatgaagtccctcggcgggggccgccgggggaccggcgcccagggcgagaccctgggggagaagtggaagcgccagctgaaccagctcagcaagagcgagttcaacacctacaagcggtccggcatcatggaggtggaccgcagcgaggcgaaggaggggctgaagcggggcgagacgaccaagcacgccgtgtcccgcgggaccgccaagctgcggtggttcgtcgagcgcaacctggtgaagcccgagggcaaggtgatcgacctcggctgcgggcggggcgggtggagctactactgcgccggcctgaagaaggtcaccgaggtgaaggggtacacgaagggcggccccgggcacgaggagcccatcccgatggccacctacggctggaacctggtgaagctccactccgggaaggacgtcttcttcatcccgcccgagaagtgcgacaccctgctgtgcgacatcggcgagagctcccccaacccgaccatcgaggaggggcgcacgctccgggtgctgaagatggtggagccctggctgcgcggcaaccagttctgcatcaagatcctcaacccctacatgcccagcgtcgtggagaccctggagcagatgcagcggaagcacggcgggatgctggtgcgcaacccgctctcccggaacagcacccacgagatgtactgggtctcctgcggcaccgggaacatcgtgagcgcggtgaacatgacctcccgcatgctgctgaaccgcttcacgatggcccaccggaagcccacctacgagcgcgacgtcgacctcggcgccggcacccggcacgtggccgtggagcccgaggtcgccaacctggacatcatcgggcagcgcatcgagaacatcaagcacgagcacaagagcacctggcactacgacgaggacaacccctacaagacgtgggcgtaccacggctcctacgaggtgaagccgagcgggtccgccagctccatggtgaacggcgtcgtgaagctgctcaccaagccctgggacgtcatccccatggtgacccagatcgccatgaccgacacgacccccttcgggcagcagcgggtgttcaaggagaaggtcgacacccgcaccccgaaggccaagcggggcacggcccagatcatggaggtgaccgcgaagtggctgtggggcttcctgagccgcaacaagaagccccggatctgcacccgcgaggagttcacccggaaggtgcgcagcaacgccgccatcggggccgtcttcgtggacgagaaccagtggaactccgcgaaggaggccgtggaggacgagcggttctgggacctcgtccaccgcgagcgggagctgcacaagcagggcaagtgcgccacgtgcgtgtacaacatgatggggaagcgcgagaagaagctgggcgagttcgggaaggccaagggcagccgggccatctggtacatgtggctcggcgcgcgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgccgacgacaccgccgggtgggacacccggatcaccgaggacgacctgcagaacgaggcccgcatcacggacatcatggagccggagcacgcgctgctcgccaagtccatcttcaagctgacctaccagaacaaggtcgtgcgcgtgcagcggcccgccaagaacggcaccgtcatggacgtgatcagccgccgggaccagcgcgggtccggccaggtgggcacctacgggctgaacacgttcaccaacatggaggcccagctcatccggcagatggagagcgagggcatcttctcccccagcgagctggagacccccaacctggccgagcgcgtcctcgactggctggagaagtacggggtggagcggctgaagcgcatggcgatctccggcgacgactgcgtggtcaagccgatcgacgaccggttcgccaccgccctcacggccctgaacgacatggggaaggtgcgcaaggacatcccccagtgggagcccagcaagggctggaacgactggcagcaggtccccttctgctcccaccacttccaccagctgatcatgaaggacggccgggagatcgtcgtgccgtgccgcaaccaggacgagctcgtggggcgggcccgcgtcagccagggcgcggggtggtccctgcgggagaccgcctgcctgggcaagagctacgcccagatgtggcagctcatgtacttccaccgccgggacctgcgcctggccgcgaacgccatctgcagcgccgtgcccgtggactggatccccacctcccggaccacgtggagcatccacgcccaccaccagtggatgaccaccgaggacatgctctccgtctggaaccgcgtgtggatcgaggagaacccctggatggaggacaagacccacatcagctcctggggcgacgtgccgtacctgggcaagcgcgaggaccagtggtgcggcagcctgatcgggctcacggcccgggcgacctgggccaccaacatccaggtcgccatcaaccaggtgcgccggctgatcggcaacgagaactacctggactacatgacctccatgaagcgcttcaagaacgagagcgaccccgagggggccctctggtga

SEQ ID NO: 7997 - RNA, 9879 nt, synthetic construct
  misc_feature 1..9879: note = derived and/or modified CDS sequence (opt1) from DENV-1__GU131920__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgaccgcgagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccgccgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccggagcacctccctgagcatgacctgcatcgccgtggggctcgtgaccctgtacctgggcgtcatggtgcaggccgactccgggtgcgtgatcaactggaagggccgcgagctcaagtgcgggagcggcatcttcgtcacgaacgaggtgcacacctggaccgagcagtacaagttccaggcggacagcccgaagcggctgtccgccgccatcggcaaggcctgggaggagggggtgtgcggcatccgcagcgccacccggctggagaacatcatgtggaagcagatctccaacgagctcaaccacatcctgctggagaacgacatgaagttcaccgtcgtggtgggggacgtcgcgggcatcctcgcccaggggaagaagatgatccgcccccagcccatggagtacaagtacagctggaagtcctggggcaaggccaagatcatcggcgccgacgtgcagaacacgaccttcatcatcgacgggcccaacaccccggagtgccccgacgaccagcgggcgtggaacatctgggaggtggaggactacggcttcgggatcttcaccacgaacatctggctgaagctgcgcgacagctacacccaggtctgcgaccaccggctcatgtccgccgccatcaaggacagcaaggccgtgcacgccgacatgggctactggatcgagtccgagaagaacgagacctggaagctggcgcgcgccagcttcatcgaggtgaagacctgcatctggcccaagtcccacacgctgtggagcaacggcgtcctcgagtccgagatgatcatccccaagatctacgggggcccgatcagccagcacaactaccggcccgggtacttcacccagaccgccggcccctggcacctggggaagctggagctcgacttcgacctgtgcgagggcaccacggtggtggtcgacgagcactgcggcaaccgcgggccgtccctgcggaccaccaccgtgacgggcaagatcatccacgagtggtgctgccgcagctgcaccctgccgcccctccggttccgcggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcaccctggccgtgttcctgctcctgatcatggggcagctgacgtggaacgacctcatccgcctgtgcatcatggtgggcgcgaacgccagcgaccggatggggatgggcaccacctacctggccctcatggccaccttcaagatgcgcccgatgttcgccgtcgggctgctgttccggcgcctcacgtcccgggaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggccgccggtcctggcccctgaacgaggggatcatggccgtgggcatcgtcagcatcctgctcagctccctgctgaagaacgacgtgcccctcgccgggcccctgatcgccggcggcatgctgatcgcgtgctacgtgatcagcgggtccagcgccgacctctccctggagaaggccgccgaggtcagctgggaggaggaggccgagcactccggcgcgagccacaacatcctggtggaggtgcaggacgacgggaccatgaagatcaaggacgaggagcgcgacgacaccctcaccatcctgctgaaggccaccctcctggccgtctccggcgtgtacccgctgagcatccccgccaccctcttcgtgtggtacttctggcagaagaagaagcagcggtccggggtcctgtgggacacccccagcccgcccgaggtggagcgcgccgtgctggacgacggcatctaccggatcatgcagcgcggcctgctcgggcggtcccaggtcggcgtgggggtgttccaggagaacgtcttccacaccatgtggcacgtgacccgcggcgcggtgctgatgtaccaggggaagcggctggagcccagctgggcctccgtcaagaaggacctcatcagctacggcggcgggtggcgcctgcagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgggaggggaagatcgtgggcctctacggcaacggggtggtcaccaccagcggcacctacgtgagcgccatcgcccaggccaaggcgtcccaggaggggccgctgcccgagatcgaggacgaggtgttccgcaagcggaacctgacgatcatggacctccaccccggcagcgggaagacccgccggtacctgccggccatcgtccgcgaggccatcaagcgccggctgcgcaccctcatcctggcccccacccgggtggtggcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctcaaggacgggcccgagcgcgtgatcctggccggccccatgccggtcacggtggcctccgccgcgcagcggcgcgggcgcatcggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggacgaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtcatgctccacaacagcgagcagggcgggcgggcgtaccgccacgccatggaggagctgcccgacaccatcgagacgctgatgctcctggccctgatcgccgtgctcaccggcggggtgaccctgttcttcctgtccggccgggggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccgccagcgcacgccccaggacaaccagctcgcctacgtggtgatcgggctgctgttcatgatcctcacggtcgccgcgaacgagatgggcctgctggagaccaccaagaaggacctcgggatcggccacgtggccgtggggaaccaccaccacgccgccatgctggacgtcgacctgcaccccgcctccgcgtggaccctctacgccgtggccacgaccatcatcaccccgatgatgcggcacaccatcgagaacacgaccgccaacatcagcctgaccgccatcgcgaaccaggccgccatcctgatgggcctcgacaagggctggcccatctccaagatggacatcggggtgcccctgctggccctcggctgctacagccaggtcaaccccctgaccctgacggcggccgtgctcatgctggtggcccactacgccatcatcgggccgggcctgcaggccaaggcgacccgcgaggcccagaagcggaccgccgccgggatcatgaagaaccccaccgtcgacggcatcgtggccatcgacctcgaccccgtggtctacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtggaccgcagcgaggcgaaggaggggctcaagcggggcgagacgaccaagcacgccgtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacacgaagggcggccccgggcacgaggagcccatcccgatggccacctacggctggaacctggtcaagctgcactccgggaaggacgtgttcttcatcccgcccgagaagtgcgacaccctcctgtgcgacatcggcgagagctcccccaacccgaccatcgaggaggggcgcacgctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccgcaacagcacccacgagatgtactgggtgtcctgcggcaccgggaacatcgtgagcgcggtcaacatgacctcccggatgctcctgaaccgcttcacgatggcccaccggaagcccacctacgagcgcgacgtggacctgggcgccggcacccggcacgtggccgtcgagcccgaggtggccaacctcgacatcatcgggcagcgcatcgagaacatcaagcacgagcacaagagcacctggcactacgacgaggacaacccctacaagacgtgggcgtaccacggctcctacgaggtgaagccgagcgggtccgccagcagcatggtcaacggcgtggtcaagctgctgaccaagccctgggacgtgatccccatggtgacccagatcgccatgaccgacacgacccccttcgggcagcagcgggtcttcaaggagaaggtggacacccgcaccccgaaggccaagcggggcacggcccagatcatggaggtgaccgcgaagtggctctggggcttcctgtcccgcaacaagaagccccggatctgcacccgcgaggagttcacccggaaggtccgcagcaacgccgccatcggggccgtgttcgtggacgagaaccagtggaactccgcgaaggaggccgtcgaggacgagcggttctgggacctggtgcacaaggagcgcgagctccacaagcagggcaagtgcgccacgtgcgtgtacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgccgacgacaccgccgggtgggacacccgcatcaccgaggacgacctccagaacgaggcccgcatcacggacatcatggagccggagcacgcgctgctggccaagtccatcttcaagctcacctaccagaacaaggtggtgcgggtccagcgccccgccaagaacggcaccgtgatggacgtgatcagccggcgcgaccagcgggggtccggccaggtcggcacctacgggctgaacacgttcaccaacatggaggcccagctgatccgccagatggagagcgagggcatcttctcccccagcgagctcgagacccccaacctggccgagcgggtgctggactggctcgagaagtacggggtggagcgcctgaagcggatggcgatctccggcgacgactgcgtcgtgaagccgatcgacgaccgcttcgccaccgccctgacggccctcaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctggtcgggcgcgcccgggtgagccagggcgcggggtggagcctccgcgagaccgcctgcctgggcaagtcctacgcccagatgtggcagctgatgtacttccaccggcgcgacctccggctggccgcgaacgccatctgcagcgccgtgcccgtcgactggatccccacctcccgcaccacgtggagcatccacgcccaccaccagtggatgaccaccgaggacatgctgtccgtgtggaaccgcgtgtggatcgaggagaacccctggatggaggacaagacccacatcagctcctggggcgacgtcccgtacctcggcaagcgggaggaccagtggtgcggcagcctgatcgggctgacggcccgcgcgacctgggccaccaacatccaggtggccatcaaccaggtgcggcgcctcatcggcaacgagaactacctggactacatgacctccatgaagcggttcaagaacgagagcgaccccgagggggccctgtggtga

SEQ ID NO: 7998 - RNA, 9879 nt, synthetic construct
  misc_feature 1..9879: note = derived and/or modified CDS sequence (opt1) from DENV-1__GU131921__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatggccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccatgacggagatccagctcaccgactacggggccctgaccctggactgcagcccccgcaccggcctcgacttcaacgagatggtgctgctgacgatgaaggagaagtcctggctcgtccacaagcagtggttcctggacctgcccctcccctggaccagcggggccagcacctcccaggagacctggaaccggcaggacctgctggtgacgttcaagaccgcccacgcgaagaagcaggaggtggtcgtgctcggcagccaggagggcgccatgcacaccgccctgaccggggccacggagatccagacctccggcaccaccacgatcttcgccgggcacctgaagtgccgcctcaagatggacaagctgaccctgaagggcatgagctacgtgatgtgcaccgggtccttcaagctcgagaaggaggtcgcggagacccagcacggcacggtgctggtgcagatcaagtacgagggcaccgacgccccctgcaagatccccttcagcacccaggacgagaagggggtcacccagaacggccggctgatcacggccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccatcggcggcgtgttcacgagcgtggggaagctggtccaccagatcttcggcgccgcctacggggtcctcttctccggcgtgagctggaccatgaagatcgggatcggcgtcctgctgacctggctcggcctgaactcccgcagcacctccctgagcatgacgtgcatcgccgtggggctcgtgaccctgtacctgggcgtcatggtgcaggcggactccgggtgcgtgatcaactggaagggccgggagctcaagtgcgggagcggcatcttcgtcaccaacgaggtgcacacctggacggagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagttcaccgtcgtggtgggggacgtcgccggcatcctcgcccaggggaagaagatgatccggccccagcccatggagtacaagtacagctggaagtcctggggcaaggccaagatcatcggcgcggacgtgcagaacaccaccttcatcatcgacgggcccaacacgccggagtgccccgacgaccagcgcgcctggaacatctgggaggtggaggactacggcttcgggatcttcaccaccaacatctggctgaagctgcgggacagctacacccaggtctgcgaccaccgcctcatgtccgccgccatcaaggacagcaaggccgtgcacgcggacatgggctactggatcgagtccgagaagaacgagacgtggaagctggcccgggccagcttcatcgaggtgaagacctgcatctggcccaagtcccacaccctgtggagcaacggcgtcctcgagtccgagatgatcatccccaagatctacgggggcccgatcagccagcacaactaccgccccgggtacttcacccagacggccggcccctggcacctggggaagctggagctcgacttcgacctgtgcgagggcaccaccgtggtggtcgacgagcactgcggcaaccgggggccgtccctgcgcaccacgaccgtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgacgggcaccctggcggtgttcctgctcctgatcatggggcagctgacctggaacgacctcatccgcctgtgcatcatggtgggcgccaacgccagcgaccgcatggggatgggcaccacgtacctggccctcatggccaccttcaagatgcggccgatgttcgcggtcgggctgctgttccgccggctcacctcccgcgaggtgctgctgctcaccatcgggctgagcctggtggcctccgtcgagctccccaacagcctggaggagctgggcgacgggctcgccatgggcatcatgatcctgaagctgctcacggacttccagtcccaccagctgtgggccaccctgctcagcctgaccttcatcaagaccacgttctccctgcactacgcgtggaagaccatggccatggtgctcagcatcgtctccctgttccccctgtgcctcagcaccacctcccagaagacgacctggctgcccgtgctgctcggcagcctggggtgcaagccgctgaccatgttcctcatcgccgagaacaagatctggggccggcgctcctggcccctgaacgaggggatcatggccgtgggcatcgtcagcatcctgctcagctccctgctgaagaacgacgtgcccctcgccgggcccctgatcgcgggcggcatgctgatcgcctgctacgtgatcagcgggtccagcgccgacctctccctggagaaggccgccgaggtcagctgggaggaggaggcggagcactccggcgccagccacaacatcctggtggaggtgcaggacgacgggaccatgaagatcaaggacgaggagcgggacgacacgctcaccatcctgctgaaggccaccctcctggccgtctccggcgtgtacccgctgagcatccccgccaccctcttcgtgtggtacttctggcagaagaagaagcagcgctccggggtcctgtgggacacccccagcccgcccgaggtggagaaggcggtgctggacgacggcatctaccggatcatgcagcgcggcctgctcgggcggtcccaggtcggcgtgggggtgttccaggagaacgtcttccacacgatgtggcacgtgacccgcggcgccgtgctgatgtaccaggggaagcggctggagcccagctgggcctccgtcaagaaggacctcatcagctacggcggcgggtggcgcctgcagggctcctggaacaccggggaggaggtccaggtgatcgccgtcgagcccggcaagaaccccaagaacgtgcagaccgcccccgggacgttcaagacccccgagggcgaggtgggcgcgatcgccctggacttcaagcccgggaccagcggctcccccatcgtcaaccgggaggggaagatcgtgggcctctacggcaacggggtggtcaccacgagcggcacctacgtgagcgccatcgcccaggcgaaggcctcccaggaggggccgctgcccgagatcgaggacgaggtgttccgcaagcggaacctgaccatcatggacctccaccccggcagcgggaagacccgccggtacctgccggccatcgtccgcgaggccatcaagcggaagctgcgcacgctcatcctggcccccacccgcgtggtggcgtccgagatggccgaggccctgaagggcatgcccatccggtaccagaccaccgccgtcaagagcgagcacacgggcaaggagatcgtggacctcatgtgccacgccaccttcaccatgcgcctgctgtcccccgtgcgggtcccgaactacaacatgatcatcatggacgaggcgcacttcaccgaccccagctccatcgccgcccgcgggtacatcagcacgcgggtgggcatgggggaggccgccgcgatcttcatgaccgccacgccgcccggctccgtggaggccttcccgcagagcaacgccgtcatccaggacgaggagcgcgacatccccgagcggtcctggaacagcgggtacgagtggatcaccgacttccccggcaagacggtgtggttcgtgccctccatcaagagcggcaacgacatcgcgaactgcctccgcaagaacgggaagcgggtcatccagctgtcccgcaagaccttcgacaccgagtaccagaagaccaagaacaacgactgggactacgtggtgacgaccgacatcagcgagatgggcgccaacttccgggccgaccgcgtcatcgacccgcggcgctgcctgaagcccgtgatcctcaaggacgggcccgagcgggtgatcctggccggccccatgccggtcaccgtggcctccgcggcccagcgccgggggcgcatcggccggaaccacaacaaggagggcgaccagtacatctacatggggcagcccctgaacaacgacgaggaccacgcccactggaccgaggccaagatgctcctggacaacatcaacacgcccgagggcatcatccccgccctgttcgagccggagcgcgagaagtccgcggccatcgacggggagtaccgcctccggggcgaggcccgcaagaccttcgtcgagctgatgcggcgcggggacctgcccgtgtggctctcctacaaggtggccagcgagggcttccagtacagcgaccggcgctggtgcttcgacggcgagcggaacaaccaggtcctggaggagaacatggacgtggagatctggaccaaggagggggagcgcaagaagctgcggccccgctggctcgacgcccggacctactccgaccccctggcgctgcgcgagttcaaggagttcgccgccggccggcgcagcgtgtccggggacctcatcctggagatcggcaagctgccgcagcacctcacgcagcgggcccagaacgcgctggacaacctggtcatgctccacaacagcgagcagggcgggcgcgcctaccggcacgccatggaggagctgcccgacaccatcgagaccctgatgctcctggccctgatcgccgtgctcaccggcggggtgacgctgttcttcctgtccggccgcgggctcggcaagaccagcatcggcctgctgtgcgtcatggcgtccagcgtgctcctgtggatggcctccgtggagccccactggatcgccgccagcatcatcctggagttcttcctcatggtcctgctgatccccgagccggaccggcagcgcacgccccaggacaaccagctcgcctacgtggtgatcgggctgctgttcatgatcctcaccgtcgcggccaacgagatgggcctgctggagaccacgaagaaggacctcgggatcggccacgtggccgtggggaaccaccaccacgccgccatgctggacgtcgacctgcaccccgcgtccgcctggaccctctacgccgtggccaccaccatcatcacgccgatgatgcggcacaccatcgagaacaccaccgccaacatcagcctgacggcgatcgccaaccaggccgccatcctgatgggcctcgacaagggctggcccatctccaagatggacatcggggtgcccctgctggcgctcggctgctacagccaggtcaaccccctgaccctgaccgccgccgtgctcatgctggtggcccactacgccatcatcgggccgggcctgcaggcgaaggccacccgcgaggcccagaagcgcacggccgccgggatcatgaagaaccccaccgtcgacggcatcgtggcgatcgacctcgaccccgtggtctacgacgccaagttcgagaagcagctgggccagatcatgctgctcatcctgtgcacctcccagatcctgctcatgcggaccacgtgggccctgtgcgagagcatcaccctggccaccgggcccctcaccacgctgtgggagggctccccggggaagttctggaacaccaccatcgccgtgagcatggcgaacatcttccgcggctcctacctggccggcgccgggctcgccttcagcctgatgaagtccctgggcgggggccggcgcgggaccggcgcgcagggcgagacgctcggggagaagtggaagcggcagctgaaccagctgtccaagagcgagttcaacacctacaagcgctccggcatcatggaggtggaccggagcgaggccaaggaggggctcaagcgcggcgagaccaccaagcacgccgtctcccgggggacggccaagctgcgctggttcgtggagcggaacctggtgaagcccgagggcaaggtcatcgacctgggctgcgggcgcggcgggtggagctactactgcgccggcctcaagaaggtgaccgaggtgaaggggtacaccaagggcggccccgggcacgaggagcccatcccgatggcgacctacggctggaacctggtcaagctgcactccgggaaggacgtgttcttcatcccgcccgagaagtgcgacacgctcctgtgcgacatcggcgagagctcccccaacccgaccatcgaggaggggcggaccctgcgcgtgctcaagatggtcgagccctggctgcggggcaaccagttctgcatcaagatcctgaacccctacatgcccagcgtggtggagaccctcgagcagatgcagcgcaagcacggcgggatgctggtccggaacccgctgtcccgcaacagcacgcacgagatgtactgggtgtcctgcggcaccgggaacatcgtgagcgccgtcaacatgacctcccggatgctcctgaaccgcttcaccatggcccaccgcaagcccacctacgagcgggacgtggacctgggcgccggcacgcgccacgtggccgtcgagcccgaggtggcgaacctcgacatcatcgggcagcggatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctgctgaccaagccctgggacgtgatccccatggtgacgcagatcgccatgaccgacaccacccccttcgggcagcagcgcgtcttcaaggagaaggtggacacgcggaccccgaaggccaagcgcggcaccgcgcagatcatggaggtgaccgccaagtggctctggggcttcctgtcccggaacaagaagccccgcatctgcacgcgggaggagttcacccgcaaggtccggagcaacgccgccatcggggcggtgttcgtggacgagaaccagtggaactccgccaaggaggccgtcgaggacgagcgcttctgggacctggtgcaccgggagcgcgagctccacaagcagggcaagtgcgcgacctgcgtgtacaacatgatggggaagcgggagaagaagctgggcgagttcgggaaggccaagggcagccgcgcgatctggtacatgtggctgggcgcccggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgccgacgacaccgccgggtgggacacgcgcatcaccgaggacgacctccagaacgaggcgcggatcaccgacatcatggagccggagcacgccctgctggccaagtccatcttcaagctcacctaccagaacaaggtggtgcgcgtccagcgccccgccaagaacggcacggtgatggacgtgatcagccggcgcgaccagcgggggtccggccaggtcggcacctacgggctgaacaccttcaccaacatggaggcccagctgatccgccagatggagagcgagggcatcttctcccccagcgagctcgagacgcccaacctggcggagcgggtgctggactggctcgagaagtacggggtggagcgcctgaagcggatggccatctccggcgacgactgcgtcgtgaagccgatcgacgaccgcttcgccaccgccctgaccgccctcaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctggtcgggcgcgcgcgggtgagccagggcgccgggtggagcctccgcgagaccgcctgcctgggcaagtcctacgcccagatgtggcagctgatgtacttccaccggcgcgacctccggctggcggccaacgccatctgcagcgccgtgcccgtcgactggatccccacgtcccgcaccacctggagcatccacgcccaccaccagtggatgaccacggaggacatgctgtccgtgtggaaccgggtgtggatcgaggagaacccctggatggaggacaagacccacatcagctcctggggcgacgtcccgtacctcggcaagcgcgaggaccagtggtgcggcagcctgatcgggctgaccgcgcgcgccacctgggccacgaacatccaggtggccatcaaccaggtgcggcgcctcatcggcaacgagaactacctggactacatgacctccatgaagcggttcaagaacgagagcgaccccgagggggccctgtggtga

SEQ ID NO: 7999 - RNA, 9879 nt, synthetic construct
  misc_feature 1..9879: note = derived and/or modified CDS sequence (opt1) from DENV-1__GQ868635__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatggccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcgccgcctacggggtcctcttctccggcgtgagctggaccatgaagatcgggatcggcgtcctgctgacctggctcggcctgaactcccgcagcacgtccctgagcatgacctgcatcgccgtggggctcgtgaccctgtacctgggcgtcatggtgcaggcggactccgggtgcgtgatcaactggaagggccgggagctcaagtgcgggagcggcatcttcgtcaccaacgaggtgcacacgtggaccgagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagttcaccgtcgtggtgggggacgtcgccggcatcctcgcccaggggaagaagatgatccggccccagcccatggagtacaagtacagctggaagtcctggggcaaggccaagatcatcggcgcggacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggtctgcgaccaccgcctcatgtccgccgccatcaaggacagcaaggccgtgcacgcggacatgggctactggatcgagtccgagaagaacgagacctggaagctggcccgggccagcttcatcgaggtgaagacctgcatctggcccaagtcccacaccctgtggagcaacggcgtcctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggcggtgttcctgctcctgatcatggggcagctgacctggaacgacctcatccgcctgtgcatcatggtgggcgccaacgccagcgaccgcatggggatgggcacgacctacctggccctcatggccaccttcaagatgcggccgatgttcgcggtcgggctgctgttccgccggctcacctcccgcgaggtgctgctgctcacgatcgggctgagcctggtggcctccgtcgagctccccaacagcctggaggagctgggcgacgggctcgccatgggcatcatgatcctgaagctgctcaccgacttccagtcccaccagctgtgggccaccctgctcagcctgaccttcatcaagacgaccttctccctgcactacgcgtggaagaccatggccatggtgctcagcatcgtctccctgttccccctgtgcctcagcaccacgtcccagaagaccacctggctgcccgtgctgctcggcagcctggggtgcaagccgctgaccatgttcctcatcgccgagaacaagatctggggccggcgctcctggcccctgaacgaggggatcatggccgtgggcatcgtcagcatcctgctcagctccctgctgaagaacgacgtgcccctcgccgggcccctgatcgcgggcggcatgctgatcgcctgctacgtgatcagcgggtccagcgccgacctctccctggagaaggccgccgaggtcagctgggaggaggaggcggagcactccggcgccagccacaacatcctggtggaggtgcaggacgacgggacgatgaagatcaaggacgaggagcgggacgacaccctcaccatcctgctgaaggccaccctcctggccgtctccggcgtgtacccgctgagcatccccgccaccctcttcgtgtggtacttctggcagaagaagaagcagcgctccggggtcctgtgggacacgcccagcccgcccgaggtggagaaggcggtgctggacgacggcatctaccggatcatgcagcgcggcctgctcgggcggtcccaggtcggcgtgggggtgttccaggagaacgtcttccacaccatgtggcacgtgacccgcggcgccgtgctgatgtaccaggggaagcggctggagcccagctgggcctccgtcaagaaggacctcatcagctacggcggcgggtggcgcctgcagggctcctggaacaccggggaggaggtccaggtgatcgccgtcgagcccggcaagaaccccaagaacgtgcagacggcccccgggaccttcaagacccccgagggcgaggtgggcgcgatcgccctggacttcaagcccgggaccagcggctcccccatcgtcaaccgggaggggaagatcgtgggcctctacggcaacggggtggtcacgaccagcggcacctacgtgagcgccatcgcccaggcgaaggcctcccaggaggggccgctgcccgagatcgaggacgaggtgttccgcaagcggaacctgaccatcatggacctccaccccggcagcgggaagacgcgccggtacctgccggccatcgtccgcgaggccatcaagcggaagctgcgcaccctcatcctggcccccacccgcgtggtggcgtccgagatggccgaggccctgaagggcatgcccatccggtaccagaccacggccgtcaagagcgagcacaccggcaaggagatcgtggacctcatgtgccacgccaccttcaccatgcgcctgctgtcccccgtgcgggtcccgaactacaacatgatcatcatggacgaggcgcacttcacggaccccagctccatcgccgcccgcgggtacatcagcacccgggtgggcatgggggaggccgccgcgatcttcatgaccgccacgccgcccggctccgtggaggccttcccgcagagcaacgccgtcatccaggacgaggagcgcgacatccccgagcggtcctggaacagcgggtacgagtggatcacggacttccccggcaagaccgtgtggttcgtgccctccatcaagagcggcaacgacatcgcgaactgcctccgcaagaacgggaagcgggtcatccagctgtcccgcaagaccttcgacaccgagtaccagaagacgaagaacaacgactgggactacgtggtgaccaccgacatcagcgagatgggcgccaacttccgggccgaccgcgtcatcgacccgcggcgctgcctgaagcccgtgatcctcaaggacgggcccgagcgggtgatcctggccggccccatgccggtcaccgtggcctccgcggcccagcgccgggggcgcatcggccggaaccacaacaaggagggcgaccagtacatctacatggggcagcccctgaacaacgacgaggaccacgcccactggacggaggccaagatgctcctggacaacatcaacacccccgagggcatcatccccgccctgttcgagccggagcgcgagaagtccgcggccatcgacggggagtaccgcctccggggcgaggcccgcaagaccttcgtcgagctgatgcggcgcggggacctgcccgtgtggctctcctacaaggtggccagcgagggcttccagtacagcgaccggcgctggtgcttcgacggcgagcggaacaaccaggtcctggaggagaacatggacgtggagatctggaccaaggagggggagcgcaagaagctgcggccccgctggctcgacgcccggacgtactccgaccccctggcgctgcgcgagttcaaggagttcgccgccggccggcgcagcgtgtccggggacctcatcctggagatcggcaagctgccgcagcacctcacccagcgggcccagaacgcgctggacaacctggtcatgctccacaacagcgagcagggcgggcgcgcctaccggcacgccatggaggagctgcccgacaccatcgagaccctgatgctcctggccctgatcgccgtgctcacgggcggggtgaccctgttcttcctgtccggccgcgggctcggcaagaccagcatcggcctgctgtgcgtcatggcgtccagcgtgctcctgtggatggcctccgtggagccccactggatcgccgccagcatcatcctggagttcttcctcatggtcctgctgatccccgagccggaccggcagcgcacgccccaggacaaccagctcgcctacgtggtgatcgggctgctgttcatgatcctcaccgtcgcggccaacgagatgggcctgctggagacgaccaagaaggacctcgggatcggccacgtggccgtggggaaccaccaccacgccgccatgctggacgtcgacctgcaccccgcgtccgcctggaccctctacgccgtggccaccacgatcatcaccccgatgatgcggcacaccatcgagaacaccacggccaacatcagcctgaccgcgatcgccaaccaggccgccatcctgatgggcctcgacaagggctggcccatctccaagatggacatcggggtgcccctgctggcgctcggctgctacagccaggtcaaccccctgaccctgaccgccgccgtgctcatgctggtggcccactacgccatcatcgggccgggcctgcaggcgaaggccacgcgcgaggcccagaagcgcaccgccgccgggatcatgaagaaccccaccgtcgacggcatcgtggcgatcgacctcgaccccgtggtctacgacgccaagttcgagaagcagctgggccagatcatgctgctcatcctgtgcacctcccagatcctgctcatgcggacgacctgggccctgtgcgagagcatcaccctggccaccgggcccctcacgaccctgtgggagggctccccggggaagttctggaacaccaccatcgccgtgagcatggcgaacatcttccgcggctcctacctggccggcgccgggctcgccttcagcctgatgaagtccctgggcgggggccggcgcgggacgggcgcgcagggcgagaccctcggggagaagtggaagcggcagctgaaccagctgtccaagagcgagttcaacacctacaagcgctccggcatcatggaggtggaccggagcgaggccaaggaggggctcaagcgcggcgagaccacgaagcacgccgtctcccgggggaccgccaagctgcgctggttcgtggagcggaacctggtgaagcccgagggcaaggtcatcgacctgggctgcgggcgcggcgggtggagctactactgcgccggcctcaagaaggtgaccgaggtgaaggggtacaccaagggcggccccgggcacgaggagcccatcccgatggcgacgtacggctggaacctggtcaagctgcactccgggaaggacgtgttcttcatcccgcccgagaagtgcgacaccctcctgtgcgacatcggcgagagctcccccaacccgaccatcgaggaggggcggaccctgcgcgtgctcaagatggtcgagccctggctgcggggcaaccagttctgcatcaagatcctgaacccctacatgcccagcgtggtggagacgctcgagcagatgcagcgcaagcacggcgggatgctggtccggaacccgctgtcccgcaacagcacccacgagatgtactgggtgtcctgcggcaccgggaacatcgtgagcgccgtcaacatgacctcccggatgctcctgaaccgcttcaccatggcccaccgcaagcccacgtacgagcgggacgtggacctgggcgccggcacccgccacgtggccgtcgagcccgaggtggcgaacctcgacatcatcgggcagcggatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctgctgacgaagccctgggacgtgatccccatggtgacccagatcgccatgaccgacaccacgcccttcgggcagcagcgcgtcttcaaggagaaggtggacacccggaccccgaaggccaagcgcggcaccgcgcagatcatggaggtgacggccaagtggctctggggcttcctgtcccggaacaagaagccccgcatctgcacccgggaggagttcacccgcaaggtccggagcaacgccgccatcggggcggtgttcgtggacgagaaccagtggaactccgccaaggaggccgtcgaggacgagcgcttctgggacctggtgcaccgggagcgcgagctccacaagcagggcaagtgcgcgacctgcgtgtacaacatgatggggaagcgggagaagaagctgggcgagttcgggaaggccaagggcagccgcgcgatctggtacatgtggctgggcgcccggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgccgacgacacggccgggtgggacacccgcatcaccgaggacgacctccagaacgaggcgcggatcaccgacatcatggagccggagcacgccctgctggccaagtccatcttcaagctcacgtaccagaacaaggtggtgcgcgtccagcgccccgccaagaacggcaccgtgatggacgtgatcagccggcgcgaccagcgggggtccggccaggtcggcacctacgggctgaacaccttcacgaacatggaggcccagctgatccgccagatggagagcgagggcatcttctcccccagcgagctcgagacccccaacctggcggagcgggtgctggactggctcgagaagtacggggtggagcgcctgaagcggatggccatctccggcgacgactgcgtcgtgaagccgatcgacgaccgcttcgccaccgccctgaccgccctcaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctggtcgggcgcgcgcgggtgagccagggcgccgggtggagcctccgcgagacggcctgcctgggcaagtcctacgcccagatgtggcagctgatgtacttccaccggcgcgacctccggctggcggccaacgccatctgcagcgccgtgcccgtcgactggatccccacctcccgcaccacctggagcatccacgcccaccaccagtggatgacgaccgaggacatgctgtccgtgtggaaccgggtgtggatcgaggagaacccctggatggaggacaagacccacatcagctcctggggcgacgtcccgtacctcggcaagcgcgaggaccagtggtgcggcagcctgatcgggctgaccgcgcgcgccacgtgggccaccaacatccaggtggccatcaaccaggtgcggcgcctcatcggcaacgagaactacctggactacatgacctccatgaagcggttcaagaacgagagcgaccccgagggggccctgtggtga

SEQ ID NO: 8000 - RNA, 9879 nt, synthetic construct
  misc_feature 1..9879: note = derived and/or modified CDS sequence (opt1) from DENV-1__GQ868636__SS-prME
  source 1..9879: mol_type = other RNA
agcgtgaccatgctgctcatgctgatgcccaccgccctggccttccacctcaccacccggggcggggagccccacatgatcgtgaccaagcaggagcgggggaagtccctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtcacctacgggacctgctcccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtgctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcctcggcgaggtcgacagcttctccctggggctgctctgcatcagcatcatgatcgaggaggtgatgcgctcccggtggagccgcaagatgctgatggccggcaccctggccgtgttcctcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtgggcctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccctcagcctgcaccacgcctggaagaccatggcgatggtcctgtccatcgtgagcctcttccccctgtgcctgtccaccacgagccagaagaccacctggctccccgtgctgctgggctccctcgggtgcaagccgctgaccatgttcctgatcgccgagaacaagatctggggccgcaagagctggcccctcaacgaggggatcatggccgtcggcgtggtgtccatcctgctgagcagcctcctgaagaacgacgtccccctggccgggcccctcatcgccggcggcatgctgatcgcgtgctacgtgatctccgggagctccgccgacctgagcctcgagaaggccgccgaggtgtcctgggaggaggaggccgagcacagcggcgcgtcccacaacatcctggtcgaggtgcaggacgacgggacgatgaagatcaaggacgaggagcgggacgacaccctgaccatcctcctgaaggccaccctgctcgccatcagcggcgtgtacccgctgtccatccccgccaccctgttcgtctggtacttctggcagaagaagaagcagcgcagcggggtgctgtgggacacgcccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctcatgtaccaggggaagcgcctggagccctcctgggccagcgtgaagaaggacctgatctcctacggcggcgggtggcggctccagggcagctggaacaccggggaggaggtgcaggtcatcgccgtggagcccggcaagaaccccaagaacgtgcagacggcccccgggaccttcaagacccccgagggcgaggtcggcgccatcgcgctggacttcaagcccgggacctccggcagccccatcgtgaaccgcgaggggaagatcgtgggcctgtacggcaacggggtcgtgacgacctccggcacctacgtgagcgccatcgcccaggccaaggcgagccaggaggggccgctccccgagatcgaggacgaggtcttccggaagcgcaacctgaccatcatggacctgcaccccggctccgggaagacgcggcgctacctcccggccatcgtgcgggaggccatcaagcgcaagctgcggaccctgatcctcgcccccacccgcgtggtcgccagcgagatggcggaggccctgaagggcatgcccatccgctaccagaccacggccgtgaagtccgagcacaccggcaaggagatcgtggacctgatgtgccacgccaccttcaccatgcggctcctgagccccgtccgcgtgccgaactacaacatgatcatcatggacgaggcccacttcacggacccctccagcatcgcggcccgggggtacatctccacccgcgtgggcatgggggaggccgccgccatcttcatgaccgcgacgccgcccggcagcgtcgaggccttcccgcagtccaacgccgtgatccaggacgaggagcgggacatccccgagcgcagctggaactccgggtacgagtggatcacggacttccccggcaagaccgtgtggttcgtccccagcatcaagtccggcaacgacatcgccaactgcctgcggaagaacgggaagcgcgtgatccagctcagccggaagaccttcgacaccgagtaccagaagacgaagaacaacgactgggactacgtggtcaccaccgacatctccgagatgggcgcgaacttccgcgccgaccgggtgatcgacccgcgccggtgcctgaagcccgtgatcctgaaggacgggcccgagcgcgtcatcctcgccggccccatgccggtgaccgtcgccagcgccgcgcagcggcgcgggcggatcggccgcaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgggagaagtccgccgcgatcgacggggagtaccgcctgcgcggcgaggcccggaagaccttcgtggagctcatgcgccgcggggacctgcccgtgtggctgagctacaaggtcgcctccgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacgtacagcgaccccctcgccctgcgggagttcaaggagttcgcggccggccgccggtccgtcagcggggacctgatcctcgagatcggcaagctgccgcagcacctgacccagcgcgcccagaacgccctcgacaacctggtgatgctgcacaactccgagcagggcgggcgggcgtaccgccacgccatggaggagctccccgacaccatcgagaccctgatgctgctcgccctgatcgccgtgctgacgggcggggtcaccctcttcttcctgagcggccgggggctgggcaagacctccatcggcctcctgtgcgtgatggccagctccgtgctgctctggatggcgagcgtcgagccccactggatcgccgcctccatcatcctggagttcttcctgatggtgctcctgatccccgagccggaccgccagcggacgccccaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccaccatgctcgacgtggacctgcaccccgccagcgcctggaccctgtacgcggtggccacgaccatcatcaccccgatgatgcgccacaccatcgagaacacgaccgccaacatctccctcaccgccatcgccaaccaggcggccatcctgatggggctggacaagggctggcccatcagcaagatggacatcggcgtccccctcctggccctggggtgctactcccaggtgaaccccctcaccctgacggccgcggtgctgatgctcgtcgcccactacgccatcatcggcccggggctgcaggccaaggccacccgggaggcgcagaagcgcaccgccgccggcatcatgaagaaccccaccgtggacgggatcgtggccatcgacctggaccccgtcgtgtacgacgccaagttcgagaagcagctcggccagatcatgctgctgatcctctgcacgagccagatcctgctgatgcgcaccacctgggcgctctgcgagtccatcaccctggccacgggccccctgaccaccctctgggaggggagcccgggcaagttctggaacaccacgatcgccgtgtccatggccaacatcttccgggggagctacctggccggcgcgggcctggccttctccctcatgaagtccctcgggggcgggcgccgggggaccggggcccagggcgagaccctgggcgagaagtggaagcgccagctcaaccagctgagcaagtccgagttcaacatctacaagcggagcgggatcatggaggtcgaccgctccgaggccaaggagggcctgaagcgcggggagaccacgcgccacgcggtgagccggggcaccgccaagctgcgctggttcgtggagcggaacctcgtcaagcccgaggggaaggtgatcgacctgggctgcggccgcgggggctggtcctactactgcgccgggctgaagaaggtgaccgaggtcaagggctacaccaagggcgggcccggccacgaggagcccatcccgatggccacgtacgggtggaacctcgtgaagctgcacagcggcaaggacgtgttcttcacgccgcccgagcggtgcgacaccctgctctgcgacatcggggagtccagccccaacccgaccatcgaggagggccgcacgctgcgggtcctgaagatggtggagccctggctccgcgggaaccagttctgcatcaagatcctgaacccctacatgccctccgtggtcgagaccctggagcagatgcagcggaagcacggcggcatgctcgtgcgcaacccgctgagccggaactccacccacgagatgtactgggtgagctgcgggaccggcaacatcgtctccgccgtgaacatgaccagccgcatgctgctcaaccgcttcacgatggcgcaccggaagcccacctacgagcgcgacgtggacctgggggccggcacccggcacgtcgccgtggagcccgaggtggccaacctggacatcatcggccagcgcatcgagaacatcaagcacgagcacaagtccacctggcactacgacgaggacaacccctacaagacgtgggcctaccacgggagctacgaggtcaagccgtccggcagcgcgtccagcatggtgaacggggtcgtgaagctcctgaccaagccctgggacgtgatccccatggtcacccagatcgccatgaccgacacgacccccttcggccagcagcgggtgttcaaggagaaggtggacacccgcaccccgaaggccaagcgggggacggcccagatcatggaggtcaccgcccgctggctgtggggcttcctcagccggaacaagaagccccgcatctgcacccgggaggagttcacccgcaaggtgcggtccaacgcggccatcggcgccgtgttcgtcgacgagaaccagtggaacagcgccaaggaggcggtggaggacgagcgcttctgggacctggtgcagaaggagcgggagctgcacaagcaggggaagtgcgccacgtgcgtctacaacatgatgggcaagcgcgagaagaagctcggggagttcggcaaggccaaggggtcccgggccatctggtacatgtggctgggcgcccgcttcctggagttcgaggcgctcggcttcatgaacgaggaccactggttcagccgggagaactccctgagcggggtggagggcgaggggctgcacaagctcggctacatcctgcgcgacatctccaagatccccgggggcaacatgtacgccgacgacaccgccggctgggacacccggatcaccgaggacgacctgcagaacgaggccaagatcacggacatcatggagccggagcacgccctcctggcgaccagcatcttcaagctgacctaccagaacaaggtggtccgcgtgcagcgccccgccaagaacgggaccgtgatggacgtcatctcccggcgcgaccagcggggcagcggccaggtgggcacgtacggcctcaacaccttcaccaacatggaggcccagctgatccgccagatggagtccgaggggatcttcctgcccagcgagctcgagacccccaacctggccgagcgggtgctggactggctcgagaagcacggcgtcgagcgcctgaagcggatggccatctccggggacgactgcgtggtgaagccgatcgacgaccgcttcgcgacggccctgaccgccctcaacgacatgggcaaggtccggaaggacatcccccagtgggagcccagcaaggggtggaacgactggcagcaggtccccttctgctcccaccacttccaccagctgatcatgaaggacggccgcgagatcgtggtcccgtgccggaaccaggacgagctggtgggccgcgcccgggtgagccagggggccggctggtccctccgcgagaccgcgtgcctgggcaagagctacgcccagatgtggcagctgatgtacttccaccggcgcgacctccggctggccgccaacgcgatctgcagcgccgtccccgtggactgggtgcccacctcccgcacgacctggagcatccacgcccaccaccagtggatgaccaccgaggacatgctgtccgtctggaaccgggtgtggatcgaggagaacccctggatggaggacaagacgcacgtgagctcctggggcgacgtcccgtacctcgggaagcgcgaggaccagtggtgcggcagcctgatcggcctgaccgcccgcgccacctgggcgtccaacatccaggtggccatcaaccaggtgcggcgcctcatcgggaacgagaactacctggactacatgaccagcatgaagcggttcaagaacgagggcgaccccgagggggccctgtggtga

SEQ ID NO: 8001 - RNA, 9879 nt, synthetic construct
  misc_feature 1..9879: note = derived and/or modified CDS sequence (opt1) from DENV-1__GU131922__SS-prME
  source 1..9879: mol_type = other RNA
agcgtgatcatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacccgcaccgagacctggatgagctccgagggcgcctggaagcagatccagcgggtcgagacctgggccctccgccaccccgggttcaccgtgatcgccctgttcctggcgcacgccatcggcacgagcatcacccagaaggggatcatcttcatcctcctgatgctggtgaccccctccatggccatgcggtgcgtcggcatcggcagccgcgacttcgtggaggggctctccggcgccacctgggtggacgtcgtgctggagcacgggagctgcgtgacgaccatggccaaggacaagcccaccctggacatcgagctcctgaagaccgaggtcacgaaccccgcgatcctgcggaagctctgcatcgaggccaagatctccaacaccaccaccgacagccgctgcccgacgcagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgacgaagctggagggcaagatcgtgcagtacgagaacctgaagtacagcgtcatcgtgaccgtgcacaccggcgaccagcaccaggtcgggaacgagtccaccgagcacggcacgaccgcgaccatcacgccccaggcccccaccacggagatccagctcaccgactacggggccctgaccctggactgcagcccccgcaccggcctcgacttcaacgagatggtgctgctgacgatgaaggagaagtcctggctcgtccacaagcagtggttcctggacctgcccctcccctggaccagcggggccagcacctcccaggagacctggaaccggcaggacctgctggtgacgttcaagaccgcccacgcgaagaagcaggaggtggtcgtgctcggcagccaggagggcgccatgcacaccgccctgaccggggccacggagatccagacctccggcaccaccacgatcttcgccgggcacctgaagtgccgcctcaagatggacaagctgaccctgaagggcatgagctacgtgatgtgcaccgggtccttcaagctcgagaaggaggtcgcggagacccagcacggcacggtgctggtgcagatcaagtacgagggcaccgacgccccctgcaagatccccttcagcacccaggacgagaagggggtcacccagaacggccggctgatcacggccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccatcggcggcgtgttcacgagcgtggggaagctggtccaccagatcttcggcaccgcctacggggtcctcttctccggcgtgagctggaccatgaagatcgggatcggcgtcctgctgacctggctcggcctgaactcccgcagcacgtccctgagcatgacctgcatcgccgtggggctcgtgaccctgtacctgggcgtcatggtgcaggccgactccgggtgcgtgatcaactggaagggccgggagctcaagtgcgggagcggcatcttcgtcaccaacgaggtgcacacgtggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgcgggcatcctcgcccaggggaagaagatgatccggccccagcccatggagtacaagtacagctggaagtcctggggcaaggccaagatcatcggcgccgacgtgcagaacaccacgttcatcatcgacgggcccaacaccccggagtgccccgacgaccagcgcgcgtggaacatctgggaggtggaggactacggcttcgggatcttcaccaccaacatctggctgaagctgcgggacagctacacgcaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacaccctgtggagcaacggcgtcctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggccgtgttcctgctcctgatcatggggcagctgacctggaacgacctcatccgcctgtgcatcatggtgggcgcgaacgccagcgaccgcatggggatgggcacgacctacctggccctcatggccaccttcaagatgcggccgatgttcgccgtcgggctgctgttccgccggctcacctcccgcgaggtgctgctgctcacgatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgaccttcatcaagacgaccttctccctgcactacgcctggaagaccatggcgatggtgctcagcatcgtctccctgttccccctgtgcctcagcaccacgtcccagaagaccacctggctgcccgtgctgctcggcagcctggggtgcaagccgctgaccatgttcctcatcgccgagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcgtgctacgtgatcagcgggtccagcgccgacctctccctggagaaggccgccgaggtcagctgggaggaggaggccgagcactccggcgcgagccacaacatcctggtggaggtgcaggacgacgggacgatgaagatcaaggacgaggagcgggacgacaccctcaccatcctgctgaaggccaccctcctggccgtctccggcgtgtacccgctgagcatccccgccaccctcttcgtgtggtacttctggcagaagaagaagcagcgctccggggtcctgtgggacacgcccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacccggggcgcggtgctgatgtaccaggggaagcgcctggagcccagctgggcctccgtcaagaaggacctcatcagctacggcggcgggtggcggctgcagggctcctggaacaccggggaggaggtccaggtgatcgccgtcgagcccggcaagaaccccaagaacgtgcagacggcccccgggaccttcaagacccccgagggcgaggtgggcgccatcgcgctggacttcaagcccgggaccagcggctcccccatcgtcaaccgcgaggggaagatcgtgggcctctacggcaacggggtggtcacgaccagcggcacctacgtgagcgccatcgcccaggccaaggcgtcccaggaggggccgctgcccgagatcgaggacgaggtgttccggaagcgcaacctgaccatcatggacctccaccccggcagcgggaagacgcggcgctacctgccggccatcgtccgggaggccatcaagcgcaagctgcgcaccctcatcctggcccccacccgggtggtggcctccgagatggcggaggccctgaagggcatgcccatccgctaccagaccacggccgtcaagagcgagcacaccggcaaggagatcgtggacctcatgtgccacgccaccttcaccatgcggctgctgtcccccgtgcgcgtcccgaactacaacatgatcatcatggacgaggcccacttcacggaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcacggacttccccggcaagaccgtgtggttcgtgccctccatcaagagcggcaacgacatcgccaactgcctccggaagaacgggaagcgcgtcatccagctgtcccggaagaccttcgacaccgagtaccagaagacgaagaacaacgactgggactacgtggtgaccaccgacatcagcgagatgggcgcgaacttccgcgccgaccgggtcatcgacccgcgccggtgcctgaagcccgtgatcctcaaggacgggcccgagcgcgtgatcctggccggccccatgccggtcaccgtggcctccgccgcgcagcggcgcgggcggatcggccgcaaccacaacaaggagggcgaccagtacatctacatggggcagcccctgaacaacgacgaggaccacgcccactggacggaggccaagatgctcctggacaacatcaacacccccgagggcatcatccccgccctgttcgagccggagcgcgagaagtccgccgcgatcgacggggagtaccggctccgcggcgaggcccggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacgtactccgaccccctggccctgcgggagttcaaggagttcgcggccggccgccggagcgtgtccggggacctcatcctggagatcggcaagctgccgcagcacctcacccagcgcgcccagaacgccctggacaacctggtcatgctccacaacagcgagcagggcgggcgggcgtaccgccacgccatggaggagctgcccgacaccatcgagaccctgatgctcctggccctgatcgccgtgctcacgggcggggtgaccctgttcttcctgtccggccgggggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccgccagcggacgccccaggacaaccagctcgcctacgtggtgatcgggctgctgttcatgatcctcaccgtcgccgcgaacgagatgggcctgctggagacgaccaagaaggacctcgggatcggccacgtggccgtggggaaccaccaccacgccgccatgctggacgtcgacctgcaccccgcctccgcgtggaccctctacgccgtggccaccacgatcatcaccccgatgatgcgccacaccatcgagaacaccacggccaacatcagcctgaccgccatcgcgaaccaggccgccatcctgatgggcctcgacaagggctggcccatctccaagatggacatcggggtgcccctgctggccctcggctgctacagccaggtcaaccccctgaccctgaccgcggccgtgctcatgctggtggcccactacgccatcatcgggccgggcctgcaggccaaggcgacgcgcgaggcccagaagcggaccgccgccgggatcatgaagaaccccaccgtcgacggcatcgtggccatcgacctcgaccccgtggtctacgacgcgaagttcgagaagcagctgggccagatcatgctgctcatcctgtgcacctcccagatcctgctcatgcgcacgacctgggccctgtgcgagagcatcaccctggccaccgggcccctcacgaccctgtgggagggctccccggggaagttctggaacaccaccatcgccgtgagcatggccaacatcttccggggctcctacctggcgggcgccgggctcgccttcagcctgatgaagtccctgggcgggggccgccgggggacgggcgcccagggcgagaccctcggggagaagtggaagcgccagctgaaccagctgtccaagagcgagttcaacacctacaagcggtccggcatcatggaggtggaccgcagcgaggcgaaggaggggctcaagcggggcgagaccacgaagcacgccgtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacaccaagggcggccccgggcacgaggagcccatcccgatggccacgtacggctggaacctggtcaagctgcactccgggaaggacgtgttcttcatcccgcccgagaagtgcgacaccctcctgtgcgacatcggcgagagctcccccaacccgaccatcgaggaggggcgcaccctgcgggtgctcaagatggtcgagccctggctgcgcggcaaccagttctgcatcaagatcctgaacccctacatgcccagcgtggtggagacgctcgagcagatgcagcggaagcacggcgggatgctggtccgcaacccgctgtcccggaacagcacccacgagatgtactgggtgtcctgcggcaccgggaacatcgtgagcgcggtcaacatgacctcccgcatgctcctgaaccgcttcaccatggcccaccggaagcccacgtacgagcgcgacgtggacctgggcgccggcacccggcacgtggccgtcgagcccgaggtggccaacctcgacatcatcgggcagcgcatcgagaacatcaagcacgagcacaagagcacctggcactacgacgaggacaacccctacaagacctgggcgtaccacggctcctacgaggtgaagccgagcgggtccgccagcagcatggtcaacggcgtggtcaagctgctgacgaagccctgggacgtgatccccatggtgacccagatcgccatgaccgacaccacgcccttcgggcagcagcgggtcttcaaggagaaggtggacacccgcaccccgaaggccaagcggggcaccgcccagatcatggaggtgacggcgaagtggctctggggcttcctgtcccgcaacaagaagccccggatctgcacccgcgaggagttcacccggaaggtccgcagcaacgccgccatcggggccgtgttcgtggacgagaaccagtggaactccgcgaaggaggccgtcgaggacgagcggttctgggacctggtgcacaaggagcgcgagctccacaagcagggcaagtgcgcgacctgcgtgtacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgccgacgacacggccgggtgggacacccgcatcaccgaggacgacctccagaacgaggcccggatcaccgacatcatggagccggagcacgcgctgctggccaagtccatcttcaagctcacgtaccagaacaaggtggtgcgcgtccagcgccccgccaagaacggcaccgtgatggacgtgatcagccggcgcgaccagcgggggtccggccaggtcggcacctacgggctgaacaccttcacgaacatggaggcccagctgatccgccagatggagagcgagggcatcttctcccccagcgagctcgagacccccaacctggccgagcgggtgctggactggctcgagaagtacggggtggagcgcctgaagcggatggcgatctccggcgacgactgcgtcgtgaagccgatcgacgaccgcttcgccaccgccctgaccgccctcaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctggtcgggcgcgcccgggtgagccagggcgcggggtggagcctccgcgagacggcctgcctgggcaagtcctacgcccagatgtggcagctgatgtacttccaccggcgcgacctccggctggccgcgaacgccatctgcagcgccgtgcccgtcgactggatccccacctcccgcaccacctggagcatccacgcccaccaccagtggatgacgaccgaggacatgctgtccgtgtggaaccgggtgtggatcgaggagaacccctggatggaggacaagacccacatcagctcctggggcgacgtcccgtacctcggcaagcgcgaggaccagtggtgcggcagcctgatcgggctgaccgcccgcgcgacgtgggccaccaacatccaggtggccatcaaccaggtgcggcgcctcatcggcaacgagaactacctggactacatgacctccatgaagcggttcaagaacgagagcgaccccgagggggccctgtggtga

SEQ ID NO: 8002 - RNA, 9879 nt, synthetic construct
  misc_feature 1..9879: note = derived and/or modified CDS sequence (opt1) from DENV-1__GU131923__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccgtcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaaggggatcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctgcgggacagctacacccaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggccgtgttcctgctcctgatcatggggcagctgacgtggaacgacctcatccgcctgtgcatcatggtgggcgcgaacgccagcgaccgcatggggatgggcaccacctacctggccctcatggccaccttcaagatgcggccgatgttcgccgtcgggctgctgttccgccggctcacgtcccgcgaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggcaagcggtcctggcccctgaacgaggggatcatggccgtgggcatcgtcagcatcctgctcagctccctgctgaagaacgacgtgcccctcgccgggcccctgatcgccggcggcatgctgatcgcgtgctacgtgatcagcgggtccagcgccgacctctccctggagaaggccgccgaggtcagctgggaggaggaggccgagcactccggcgcgagccacaacatcctggtggaggtgcaggacgacgggaccatgaagatcaaggacgaggagcgcgacgacaccctcaccatcctgctgaaggccaccctcctggccgtctccggcgtgtacccgctgagcatccccgccaccctcttcgtgtggtacttctggcagaagaagaagcagcggtccggggtcctgtgggacacccccagcccgcccgaggtggagcgcgccgtgctggacgacggcatctaccggatcatgcagcgcggcctgctcgggcggtcccaggtcggcgtgggggtgttccaggagaacgtcttccacaccatgtggcacgtgacccgcggcgcggtgctgatgtaccaggggaagcggctggagcccagctgggcctccgtcaagaaggacctcatcagctacggcggcgggtggcgcctgcagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgggaggggaagatcgtgggcctctacggcaacggggtggtcaccaccagcggcacctacgtgagcgccatcgcccaggccaaggcgtcccaggaggggccgctgcccgagatcgaggacgaggtgttccgcaagcggaacctgacgatcatggacctccaccccggcagcgggaagacccgccggtacctgccggccatcgtccgcgaggccatcaagcggaagctgcgcaccctcatcctggcccccacccgcgtggtggcctccgagatggcggaggccctgaagggcatgcccatccggtaccagacgaccgccgtcaagagcgagcacaccggcaaggagatcgtggacctcatgtgccacgccaccttcacgatgcgcctgctgtcccccgtgcgggtcccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctccgcaagaacgggaagcgggtcatccagctgtcccgcaagaccttcgacacggagtaccagaagaccaagaacaacgactgggactacgtggtgaccaccgacatcagcgagatgggcgcgaacttccgggccgaccgcgtcatcgacccgcggcgctgcctgaagcccgtgatcctcaaggacgggcccgagcgggtgatcctggccggccccatgccggtcacggtggcctccgccgcgcagcgccgggggcgcatcggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccgcctccggggcgaggcccgcaagaccttcgtcgagctgatgcggcgcggggacctgcccgtgtggctctcctacaaggtggccagcgagggcttccagtacagcgaccggcgctggtgcttcgacggcgagcggaacaaccaggtcctggaggagaacatggacgtggagatctggacgaaggagggggagcgcaagaagctgcggccccgctggctcgacgcccggacctactccgaccccctggccctgcgcgagttcaaggagttcgcggccggccggcgcagcgtgtccggggacctcatcctggagatcggcaagctgccgcagcacctcacccagcgggcccagaacgccctggacaacctggtcatgctccacaacagcgagcagggcgggcgcgcgtaccggcacgccatggaggagctgcccgacaccatcgagacgctgatgctcctggccctgatcgccgtgctcaccggcggggtgaccctgttcttcctgtccggccgcgggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccggcagcgcacgccccaggacaaccagctcgcctacgtggtgatcgggctgctgttcatgatcctcacggtcgccgcgaacgagatgggcctgctggagaccaccaagaaggacctcgggatcggccacgaggccgtggggaaccaccaccacgccgccatgctggacgtggacctgcaccccgcctccgcgtggaccctctacgccgtcgccacgaccatcatcaccccgatgatgcggcacaccatcgagaacacgaccgccaacatcagcctgaccgccatcgcgaaccaggccgccatcctgatgggcctcgacaagggctggcccatctccaagatggacatcggggtgcccctgctggccctcggctgctacagccaggtgaaccccctgaccctgacggcggccgtcctcatgctggtggcccactacgccatcatcgggccgggcctgcaggccaaggcgacccgcgaggcccagaagcgcaccgccgccgggatcatgaagaaccccaccgtggacggcatcgtcgccatcgacctcgaccccgtggtgtacgacgcgaagttcgagaagcagctgggccagatcatgctgctcatcctgtgcacgtcccagatcctgctcatgcggaccacctgggccctgtgcgagagcatcaccctggccacggggcccctcaccaccctgtgggagggctccccggggaagttctggaacaccacgatcgccgtcagcatggccaacatcttccgcggctcctacctggcgggcgccgggctcgccttcagcctgatgaagtccctgggcgggggccggcgcgggaccggcgcccagggcgagaccctcggggagaagtggaagcggcagctgaaccagctgtccaagagcgagttcaacacctacaagcgctccggcatcatggaggtggaccggagcgaggcgaaggaggggctcaagcgcggcgagacgaccaagcacgccgtgtcccgggggaccgccaagctgcgctggttcgtcgagcggaacctggtgaagcccgagggcaaggtgatcgacctgggctgcgggcgcggcgggtggagctactactgcgccggcctcaagaaggtcaccgaggtgaaggggtacacgaagggcggccccgggcacgaggagcccatcccgatggccacctacggctggaacctggtgaagctgcactccgggaaggacgtcttcttcatcccgcccgagaagtgcgacaccctcctgtgcgacatcggcgagagctcccccaacccgaccatcgaggaggggcggacgctgcgcgtgctcaagatggtggagccctggctgcggggcaaccagttctgcatcaagatcctgaacccctacatgcccagcgtcgtggagaccctcgagcagatgcagcgcaagcacggcgggatgctggtgcggaacccgctgtcccgcaacagcacccacgagatgtactgggtctcctgcggcaccgggaacatcgtgagcgcggtgaacatgacctcccggatgctcctgaaccgcttcacgatggcccaccgcaagcccacctacgagcgggacgtcgacctgggcgccggcacccgccacgtggccgtggagcccgaggtcgccaacctcgacatcatcgggcagcggatcgagaacatcaagcacgagcacaagagcacctggcactacgacgaggacaacccctacaagacgtgggcgtaccacggctcctacgaggtgaagccgagcgggtccgccagcagcatggtgaacggcgtcgtgaagctgctgaccaagccctgggacgtcatccccatggtgacccagatcgccatgaccgacacgacccccttcgggcagcagcgcgtgttcaaggagaaggtcgacacccggaccccgaaggccaagcgcggcacggcccagatcatggaggtgaccgcgaagtggctctggggcttcctgtcccggaacaagaagccccgcatctgcacccgggaggagttcacccgcaaggtgcggagcaacgccgccatcggggccgtcttcgtggacgagaaccagtggaactccgcgaaggaggccgtggaggacgagcgcttctgggacctggtccaccgggagcgcgagctccacaagcagggcaagtgcgccacgtgcgtgtacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtggagggggagggcctccacaagctggggtacatcctgcgggacatcagcaagatccccggcggcaacatgtacgccgacgacaccgccgggtgggacacccgcatcaccgaggacgacctccagaacgaggcccggatcacggacatcatggagccggagcacgcgctgctggccaagtccatcttcaagctcacctaccagaacaaggtcgtgcgcgtgcagcgccccgccaagaacggcaccgtcatggacgtgatcagccggcgcgaccagcgggggtccggccaggtgggcacctacgggctgaacacgttcaccaacatggaggcccagctgatccgccagatggagagcgagggcatcttctcccccagcgagctcgagacccccaacctggccgagcgggtcctggactggctcgagaagtacggggtggagcgcctgaagcggatggcgatctccggcgacgactgcgtggtcaagccgatcgacgaccgcttcgccaccgccctgacggccctcaacgacatggggaaggtgcggaaggacatcccccagtgggagcccagcaagggctggaacgactggcagcaggtccccttctgctcccaccacttccaccagctgatcatgaaggacggccgcgagatcgtcgtgccgtgccggaaccaggacgagctggtggggcgcgcccgggtcagccagggcgcggggtggagcctccgcgagaccgcctgcctgggcaagtcctacgcccagatgtggcagctgatgtacttccaccggcgcgacctccggctggccgcgaacgccatctgcagcgccgtgcccgtggactggatccccacctcccgcaccacgtggagcatccacgcccaccaccagtggatgaccaccgaggacatgctgtccgtctggaaccgggtgtggatcgaggagaacccctggatggaggacaagacccacatcagctcctggggcgacgtgccgtacctcggcaagcgcgaggaccagtggtgcggcagcctgatcgggctgacggcccgcgcgacctgggccaccaacatccaggtcgccatcaaccaggtgcggcgcctcatcggcaacgagaactacctggactacatgacctccatgaagcggttcaagaacgagagcgaccccgagggggccctgtggtga

SEQ ID NO: 8003 - RNA, 9879 nt, synthetic construct
  misc_feature 1..9879: note = derived and/or modified CDS sequence (opt1) from DENV-1__GQ868637__SS-prME
  source 1..9879: mol_type = other RNA
agcgtgaccatgctgctgatgctgatgcccaccgccctggccttccacctcaccacccgcggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccggatcaccgaggtggagcccgacgacgtggactgctggtgcaacaccaccgacacctgggtgacctacgggacctgcagccagacgggcgagcaccggcgcgacaagcggtccgtggccctcgcgccccacgtcggcctggggctggagacccgcgccgagacctggatgagctccgagggcgcgtggaagcagatccagcgggtggagacctgggccctccgccaccccgggttcacggtgatcgccctgttcctggcccacgcgatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcggaagctctgcatcgaggcgaagatctccaacaccaccacggacagccgctgcccgacccagggcgaggccaccctggtcgaggagcaggacgccaacttcgtgtgccggcgcaccttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccggcaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccgcctcaagatggacaagctgaccctgaagggcatgtcctacgtgatgtgcaccgggagcttcaagctcgagaaggaggtggccgagacccagcacggcacggtcctggtgcagatcaagtacgagggcaccgacgcgccctgcaagatccccttctccacccaggacgagaagggggtgacccagaacggccggctgatcacggccaacccgatcgtcaccgacaaggagaagcccgtgaacatcgaggccgagccgcccttcggggagagctacatcgtgatcggcgccggcgagaaggcgctgaagctctcctggttcaagaaggggagctccatcggcaagatgttcgaggccaccgcccgcggggcccggcgcatggccatcctgggcgacaccgcgtgggacttcgggagcatcggcggcgtcttcacgtccgtggggaagctggtgcaccagatcttcggcaccgcctacggggtcctcttcagcggcgtgtcctggaccatgaagatcgggatcggcgtgctgctgacctggctcggcctgaacagccgctccacgagcctgtccatgacctgcatcgccgtcgggctcgtgaccctgtacctgggcgtgatggtccaggccgacagcgggtgcgtgatcaactggaagggccgggagctcaagtgcgggagcggcatcttcgtgaccaacgaggtccacacgtggaccgagcagtacaagttccaggccgactccccgaagcgcctgagcgcggccatcggcaaggcctgggaggagggggtgtgcggcatccggtccgccacccgcctggagaacatcatgtggcggcagatcagcaacgagctcaaccacatcctgctggagaacgacatgaagttcaccgtggtcgtgggggacgtggtcggcatcctcgcccaggggaagaagatgatccgcccccagcccatggagcacaagtactcctggaagtcctggggcaaggcgaagatcatcggcgccgacgtgcagaacaccacgttcatcatcgacgggcccaacaccccggagtgccccgacgaccagcgggcctggaacatctgggaggtggaggactacggcttcgggatcttcaccaccaacatctggctgaagctgcgcgactcctacacgcaggtctgcgaccaccggctcatgagcgccgcgatcaaggactccaaggccgtgcacgccgacatgggctactggatcgagagcgagaagaacgagacctggaagctggcccgcgcctccttcatcgaggtgaagacctgcatctggcccaagagccacaccctgtggtccaacggcgtcctcgagagcgagatgatcatccccaagatctacgggggcccgatctcccagcacaactaccggcccgggtacttcacgcagaccgcgggcccctggcacctggggaagctggagctcgacttcgacctgtgcgagggcaccaccgtggtggtcgacgagcactgcggcaaccgcgggccgagcctgcggacgaccaccgtgaccggcaagatcatccacgagtggtgctgccgctcctgcacgctgccgcccctccggttcaagggggaggacggctgctggtacgggatggagatccgccccgtgaaggagcgggaggagaacctggtcaagagcatggtgagcgccggctccggcgaggtggacagcttctccctcgggctgctgtgcatcagcatcatgatcgaggaggtcatgcgctcccggtggagccgcaagatgctcatgaccggcaccctggccgtgttcttcctgctcatcatggggcagctgacctggaacgacctgatccgcctctgcatcatggtgggcgccaacgcctccgaccggatggggatgggcacgacctacctggcgctgatggccaccttcaagatgcgcccgatgttcgccgtcggcctcctgttccggcgcctgaccagccgggaggtgctcctgctgacgatcgggctctccctggtcgccagcgtggagctgcccaactccctcgaggagctgggcgacgggctggccatgggcatcatgatcctcaagctgctgaccgacttccagagccaccagctctgggcgaccctgctgtccctcaccttcatcaagacgaccttcagcctgcactacgcctggaagaccatggccatggtgctgtccatcgtcagcctcctgcccctgtgcctctccaccacgagccagaagaccacctggctgcccgtgctgctcggctccctggggtgcaagccgctgaccatgttcctcatcgccgagaacaagatctggggccgcaagagctggcccctgaacgaggggatcatggcggtgggcatcgtcagcatcctgctctccagcctgctgaagaacgacgtgcccctcgccgggcccctgatcgccggcggcatgctgatcgcctgctacgtgatctccgggagctccgccgacctcagcctggagaaggcggccgaggtctcctgggaggaggaggccgagcacagcggcgcctcccacaacatcctggtggaggtgcaggacgacgggacgatgaagatcaaggacgaggagcgggacgacaccctcaccatcctgctgaaggccaccctcctggcggtcagcggcgtgtacccgctgtccatccccgccaccctcttcgtgtggtacttctggcagaagaagaagcagcgcagcggggtcctgtgggacacgcccagcccgcccgaggtggagcgggccgtgctggacgacggcatctaccgcatcatgcagcggggcctgctcgggcgcagccaggtcggcgtgggggtgttccaggagaacgtcttccacaccatgtggcacgtgacccggggcgccgtgctgatgtaccaggggaagcgcctggagccctcctgggccagcgtcaagaaggacctcatctcctacggcggcgggtggcggctgcagggcagctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggacctccggcagccccatcgtcaaccgcgaggggaagatcgtgggcctctacggcaacggggtggtcacgaccagcggcacctacgtgtccgccatcgcgcaggccaaggccagccaggaggggccgctgcccgagatcgaggacgaggtgttccggaagcgcaacctgaccatcatggacctccaccccggctccgggaagacgcggcgctacctgccggccatcgtccgggaggcgatcaagcgcaagctgcgcaccctcatcctggcccccacccgggtggtggccagcgagatggccgaggccctgaagggcatgcccatccgctaccagaccacggcggtcaagtccgagcacaccggccgggagatcgtggacctcatgtgccacgccaccttcaccatgcgcctgctgagccccgtgcgggtcccgaactacaacatgatcatcatggacgaggcccacttcacggacccctccagcatcgccgcccgcgggtacatctccacccgggtgggcatgggggaggcggccgccatcttcatgaccgccacgccgcccggcagcgtggaggccttcccgcagtccaacgcggtcatccaggacgaggagcgcgacatccccgagcggagctggaactccgggtacgagtggatcacggacttccccggcaagaccgtgtggttcgtgcccagcatcaagtccggcaacgacatcgccaactgcctccgcaagaacgggaagcgggtcatccagctgagccgcaagaccttcgacaccgagtaccagaagacgaagaacaacgactgggactacgtggtgaccaccgacatctccgagatgggcgccaacttccgggccgaccgcgtcatcgacccgcggcgctgcctgaagcccgtgatcctcaaggacgggcccgagcgggtcatcctggcgggccccatgccggtgaccgtggccagcgccgcccagcgccgggggcgcatcggccgcaaccacaacaaggagggcgaccagtacatctacatggggcagcccctgaacaacgacgaggaccacgcccactggacggaggcgaagatgctcctggacaacatcaacacccccgagggcatcatccccgccctgttcgagccggagcgggagaagtccgccgccatcgacggggagtaccgcctccggggcgaggcccgcaagaccttcgtcgagctgatgcggcgcggggacctgcccgtgtggctcagctacaaggtggcgagcgagggcttccagtactccgaccggcgctggtgcttcgacggcgagcggaacaaccaggtcctggaggagaacatggacgtggagatctggaccaaggagggggagcgcaagaagctgcggccccgctggctcgacgcccggacgtacagcgaccccctggccctgcgcgagttcaaggagttcgccgccggccggcgctccgtgagcggggacctcatcctggagatcggcaagctgccgcagcacctcacccagcgggcgcagaacgccctggacaacctggtcatgctccacaactccgagcagggcgggcgcgcctaccggcacgccatggaggagctgcccgacaccatcgagaccctgatgctcctggcgctgatcgccgtgctcacgggcggggtgaccctgttcttcctgagcggccgcgggctcggcaagacctccatcggcctgctgtgcgtcatggccagctccgccctcctgtggatggccagcgtggagccccactggatcgcggcctccatcatcctggagttcttcctcatggtgctgctgatccccgagccggaccggcagcgcacgccccaggacaaccagctcgcctacgtcgtgatcgggctgctgttcatgatcctcaccgtggccgccaacgagatgggcctgctggagacgaccaagaaggacctcgggatcggccacgtcgcggtggagaaccaccaccacgccaccatgctggacgtggacctgcaccccgccagcgcctggaccctctacgccgtcgcgacgaccatcatcaccccgatgatgcgccacaccatcgagaacacgaccgccaacatctccctgaccgccatcgccaaccaggccgcgatcctgatggggctcgacaagggctggcccatcagcaagatggacatcggcgtgcccctgctggccctcgggtgctactcccaggtgaaccccctgaccctgatcgccgccgtcctcatgctggtggcgcactacgccatcatcggcccggggctgcaggccaaggccacgcgggaggcccagaagcgcaccgcggccggcatcatgaagaaccccaccgtggacgggatcgtcgccatcgacctcgaccccgtggtgtacgacgccaagttcgagaagcagctgggccagatcatgctgctcatcctgtgcaccagccagatcctgctcatgcggacgacctgggccctgtgcgagtccatcaccctggcgaccggccccctcacgaccctgtgggaggggagcccgggcaagttctggaacaccaccatcgccgtctccatggccaacatcttccgcgggagctacctggccggcgccggcctcgcgttcagcctgatgaagtccctcgggggcgggcggcgcgggacgggggcccagggcgagaccctcggcgagaagtggaagcggcagctgaaccagctgagcaagtccgagttcaacacctacaagcgcagcgggatcatggaggtggaccggtccgaggccaaggagggcctccgccgcggggagaccacgaagcacgccgtgagccgcggcaccgcgaagctgcggtggttcgtcgagcgcaacctggtgaagcccgaggggaaggtgatcgacctgggctgcggccgcggcgggtggtcctactactgcgccgggctcaagaaggtcaccgaggtgaaggggtacaccaagggcgggcccggccacgaggagcccatcccgatggccacgtacgggtggaacctggtgaagctgcacagcggcaaggacgtcttcttcatcccgcccgagaagtgcgacaccctcctgtgcgacatcggggagtccagccccaacccgaccatcgaggagggccgcaccctgcgggtgctcaagatggtggagccctggctgcgcgggaaccagttctgcatcaagatcctgaacccctacatgccctccgtcgtggagacgctcgagcagatgcagcggaagcacggcggcatgctggtgcgcaacccgctgagccgcaactccacccacgagatgtactgggtcagctgcgggaccggcaacatcgtgtccgccgtgaacatgaccagccggatgctcctgaaccgcttcaccatggcccaccggaagcccacgtacgagcgcgacgtcgacctgggggcgggcacccggcacgtggccgtggagcccgaggtcgccaacctcgacatcatcggccagcgcatcgagaacatcaagcacgagcacaagtccacctggcactacgacgaggacaacccctacaagacctgggcctaccacgggagctacgaggtgaagccgtccggcagcgccagctccatggtcaacggggtggtgaagctgctgacgaagccctgggacgtcatccccatggtgacccagatcgcgatgaccgacaccacgcccttcggccagcagcgggtgttcaaggagaaggtcgacacccgcaccccgaaggccaagcgggggaccgcccagatcatggaggtgacggcccgctggctctggggcttcctgagccggaacaagaagccccgcatctgcacccgggaggagttcacccgcaaggtgcggtccaacgccgcgatcggcgccgtcttcgtggacgagaaccagtggaacagcgccaaggaggccgtggaggacgagcgcttctgggacctggtccaccgggagcgcgagctccacaagcaggggaagtgcgcgacctgcgtgtacaacatgatgggcaagcgggagaagaagctgggggagttcggcaaggccaaggggtcccgcgccatctggtacatgtggctgggcgcccggttcctcgagttcgaggccctgggcttcatgaacgaggaccactggttcagccgcgagaactccctgagcggggtggagggcgaggggctccacaagctgggctacatcctgcgcgacatctccaagatccccgggggcaacatgtacgcggacgacacggccggctgggacacccggatcaccgaggacgacctccagaacgaggccaagatcaccgacatcatggagccggagcacgccctgctggccacgagcatcttcaagctcacctaccagaacaaggtcgtgcgcgtgcagcggcccgcgaagaacgggaccgtcatggacgtgatctcccgccgggaccagcgcggcagcggccaggtgggcacctacggcctgaacacgttcaccaacatggaggcccagctgatccggcagatggagtccgaggggatcttcagcccctccgagctcgagacccccaacctggccgagcgcgtcctggactggctcgagaagtacggcgtggagcggctgaagcgcatggccatcagcggggacgactgcgtggtcaagccgatcgacgaccggttcgccaccgcgctgacggccctcaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctggtgggccgggcccgcgtcagccagggggccggctggtccctccgggagaccgcctgcctgggcaagagctacgcgcagatgtggcagctgatgtacttccaccgccgggacctccgcctggccgccaacgccatctgctccgcggtgcccgtggactgggtccccaccagccgcaccacgtggtccatccacgcccaccaccagtggatgaccaccgaggacatgctgagcgtgtggaaccgggtgtggatcgacgagaacccctggatggaggacaagacccacatctccagctggggcgacgtcccgtacctcgggaagcgcgaggaccagtggtgcggctccctgatcggcctgacggcccgggccacctgggccaccaacatccaggtggcgatcaaccaggtgcgccggctcatcgggaacgagaactacctggactacatgaccagcatgaagcgcttcaagaacgagtccgaccccgagggcgccctgtggtga

SEQ ID NO: 8004 - RNA, 9879 nt, synthetic construct
  misc_feature 1..9879: note = derived and/or modified CDS sequence (opt1) from DENV-1__GQ868639__SS-prME
  source 1..9879: mol_type = other RNA
agcgtgaccatgctgctcatgctgatgcccaccgcgctggccttccacctcaccacccggggcggggagccccacatgatcgtgagcaagcaggagcggggcaagagcctgctgttcaagaccagcgcgggggtgaacatgtgcaccctcatcgccatggacctgggcgagttctgcgaggacaccatgacctacaagtgcccccggatcagcgaggccgagcccgacgacgtggactgctggtgcaacgccaccgacacctgggtcacgtacgggacctgctcccagaccggcgagcaccggcgcgacaagcggagcgtggccctggcgccccacgtgggcctcgggctggagacccggacggagacctggatgtccagcgagggcgcctggaagcagatccagcgggtcgagacctgggccctgcgccaccccgggttcaccgtgatcgccctcttcctggcgcacgccatcggcacgtccatcacccagaaggggatcatcttcatcctgctcatgctggtgacccccagcatggccatgcggtgcgtcggcatcggctcccgcgacttcgtggaggggctgagcggcgccacctgggtggacgtcgtgctcgagcacgggtcctgcgtgacgaccatggccaaggacaagcccaccctggacatcgagctgctcaagaccgaggtcacgaaccccgcggtgctgcggaagctgtgcatcgaggccaagatcagcaacaccaccaccgactcccgctgcccgacgcagggcgaggccaccctcgtggaggagcaggacgccaacttcgtctgccggcgcaccttcgtggaccggggctgggggaacggctgcgggctgttcggcaaggggagcctgatcacgtgcgccaagttcaagtgcgtgacgaagctcgagggcaagatcgtccagtacgagaacctgaagtactccgtgatcgtgaccgtccacaccggcgaccagcaccaggtggggaacgagagcaccgagcacggcacgaccgcgaccatcacgccccaggccccctccaccgagatccagctgacggactacggggccctcaccctggactgcagcccccgcaccggcctggacttcaacgagatggtcctcctgaccatgaaggagaagtcctggctggtgcacaagcagtggttcctcgacctgccgctgccctggacgtccggggccagcacctcccaggagacctggaaccggcaggacctcctggtgaccttcaagacggcccacgcgaagaagcaggaggtcgtggtgctgggcagccaggagggcgccatgcacaccgccctcaccggggccaccgagatccagacgtccggcaccaccaccatcttcgccgggcacctgaagtgccgcctgaagatggacaagctcacgctgaagggcatgagctacgtcatgtgcaccgggtccttcaagctggagaaggaggtggcggagacccagcacggcaccgtgctcgtccagatcaagtacgagggcacggacgccccctgcaagatccccttcagcacccaggacgagaagggggtgacccagaacggccggctgatcaccgccaacccgatcgtgacggacaaggagaagcccgtcaacatcgaggccgagccgcccttcggggagtcctacatcgtgatcggcgcgggcgagaaggccctgaagctgagctggttcaagaaggggtccagcatcggcaagatgttcgaggccaccgcccgcggggcccggcgcatggcgatcctcggcgacaccgcctgggacttcgggtccatcggcggcgtgttcaccagcgtcgggaagctggtgcaccagatcttcggcacggcctacggggtgctgttctccggcgtcagctggaccatgaagatcgggatcggcgtgctcctgacctggctgggcctcaactcccgcagcacctccctgagcatgacgtgcatcgccgtggggctggtcaccctctacctgggcgtgatggtgcaggccgacagcgggtgcgtcatcaactggaagggccgggagctgaagtgcgggtccggcatcttcgtgaccaacgaggtgcacacctggacggagcagtacaagttccaggcggacagcccgaagcgcctctccgccgccatcggcaaggcctgggaggagggggtctgcggcatccggagcgccacccgcctggagaacatcatgtggaagcagatctccaacgagctgaaccacatcctcctggagaacgacatgaagttcaccgtggtggtcggggacgtggcgggcatcctggcccaggggaagaagatgatccggccccagcccatggagtacaagtacagctggaagtcctggggcaaggccaagatcatcggcgccgacgtgcagaacaccaccttcatcatcgacgggcccaacacgccggagtgccccgacgaccagcgcgcgtggaacatctgggaggtcgaggactacggcttcgggatcttcaccaccaacatctggctcaagctgcgggacagctacacccaggtgtgcgaccaccgcctgatgtccgccgccatcaaggacagcaaggccgtgcacgccgacatgggctactggatcgagtccgagaagaacgagacgtggaagctcgcgcgggccagcttcatcgaggtcaagacctgcatctggcccaagtcccacaccctgtggagcaacggcgtgctggagtccgagatgatcatccccaagatctacgggggcccgatcagccagcacaactaccgccccgggtacttcacccagacggccggcccctggcacctcgggaagctggagctggacttcgacctctgcgagggcaccaccgtggtcgtggacgagcactgcggcaaccgggggccgtccctgcgcaccacgaccgtgaccggcaagatcatccacgagtggtgctgccggagctgcaccctgccgcccctgcgcttcaagggggaggacggctgctggtacgggatggagatccggcccgtcaaggagaaggaggagaacctggtcaagagcatggtgtccgccggcagcggcgaggtcgactccttcagcctggggctcctgtgcatctccatcatgatcgaggaggtgatgcgcagccggtggtcccgcaagatgctgatgacgggcaccctcgccgtgttcttcctgctgatcatggggcagctcacctggaacgacctgatccggctgtgcatcatggtcggcgcgaacgccagcgaccgcatggggatgggcatgacctacctcgccctgatggccacgttcaagatgcgcccgatgttcgccgtgggcctcctgttccggcgcctgacctcccgggaggtgctgctcctgaccatcgggctgagcctcgtcgcgtccgtggagctgcccaacagcctggaggagctcggcgacgggctggccatgggcatcatgatcctgaagctcctggccgacttccagtcccaccagctgtgggccaccctcctgagcctgacgttcatcaagaccaccttctccctccactacgcgtggaagaccatggccatggtcctgagcatcgtgtccctgttccccctctgcctgagcacgacctcccagaagaccacctggctgcccgtgctcctgggcagcctggggtgcaagccgctcacgatgttcctgatcgccgagaacaagatctggggccgcaagagctggcccctgaacgaggggatcatggccgtcggcatcgtgtccatcctcctgagctccctgctcaagaacgacgtgcccctggccgggcccctgatcgcgggcggcatgctcatcgcctgctacgtcatcagcgggtccagcgccgacctgtccctggagaaggccgccgaggtgagctgggaggaggaggcggagcactccggcgccagccacaacatcctcgtggaggtccaggacgacgggaccatgaagatcaaggacgaggagcgggacgacaccctgaccatcctgctcaaggccacgctgctggccgtgtccggcgtgtacccgctcagcatccccgccaccctgttcgtctggtacttctggcagaagaagaagcagcgctccggggtgctgtgggacacccccagcccgcccgaggtggagcgggcggtcctcgacgacggcatctaccgcatcatgcagcggggcctgctggggcgctcccaggtgggcgtgggggtcttccaggagaacgtgttccacaccatgtggcacgtgacccggggcgccgtcctgatgtaccaggggaagcgcctcgagcccagctgggcctccgtgaagaaggacctgatcagctacggcggcgggtggcggctgcagggctcctggaacacgggggaggaggtgcaggtcatcgccgtggagcccggcaagaaccccaagaacgtgcagaccgcccccgggaccttcaagaccagcgagggcgaggtcggcgcgatcgccctcgacttcaagcccgggacgagcggctcccccatcgtgaaccgcgaggggaagatcgtgggcctgtacggcaacggggtcgtgaccaccagcggcacctacgtgtccgccatcgcccaggcgaaggccagccaggaggggcccctgccggagatcgaggacgaggtcttccggaagcgcaacctcacgatcatggacctgcaccccggctccgggaagacccggcgctacctgcccgccatcgtgcgggaggccatcaagcgcaagctccggaccctgatcctggccccgacccgcgtggtcgcgagcgagatggccgaggccctcaagggcatgcccatccgctaccagacgaccgccgtgaagtccgagcacaccggcaaggagatcgtggacctgatgtgccacgccaccttcacgatgcggctgctcagccccgtccgcgtgcccaactacaacatgatcatcatggacgaggcgcacttcaccgacccgtccagcatcgccgcccgggggtacatctccacccgcgtgggcatgggggaggccgccgcgatcttcatgaccgccacgccgcccggcagcgccgaggccttcccccagtccaacgcggtcatccaggacgaggagcgggacatcccggagcgcagctggaactccgggtacgagtggatcaccgacttccccggcaagaccgtgtggttcgtgcccagcatcaagtccggcaacgacatcgccaactgcctgcggaagaacgggaagcgcgtcatccagctgagccggaagaccttcgacacggagtaccagaagaccaagaacaacgactgggactacgtggtgaccaccgacatctccgagatgggcgccaacttccgcgccgaccgggtcatcgacccccgccggtgcctcaagccggtgatcctgaaggacgggcccgagcgcgtgatcctggccggccccatgcccgtcacggtggcgagcgccgcccagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgccatcgacggggagtaccgcctgcgcggcgaggcccggaagaccttcgtcgagctgatgcgccgcggggacctcccggtgtggctgtcctacaaggtggccagcgagggcttccagtactccgaccgccggtggtgcttcgacggcgagcgcaacaaccaggtcctggaggagaacatggacgtggagatctggacgaaggagggggagcggaagaagctccgcccccggtggctggacgcgcgcacctacagcgaccccctggccctccgggagttcaaggagttcgccgccggccgccggtccgtgagcggggacctgatcctggagatcggcaagctcccccagcacctgacccagcgcgcgcagaacgccctggacaacctcgtcatgctgcacaactccgagcagggcgggcgggcctaccgccacgccatggaggagctgccggacaccatcgagacgctcatgctgctggccctcatcgcggtgctgaccggcggggtgaccctgttcttcctcagcggccgggggctgggcaagacctccatcggcctgctctgcgtcatggccagctccgtgctgctgtggatggccagcgtggagccccactggatcgccgcctccatcatcctcgagttcttcctgatggtcctgctcatccccgagcccgaccgccagcggacgccgcaggacaaccagctggcgtacgtggtgatcgggctcctcttcatgatcctgaccgtcgccgccaacgagatgggcctgctcgagaccaccaagaaggacctggggatcggccacgtggccgtggagaaccaccaccacgccgcgatgctggacgtcgacctccaccccgccagcgcctggaccctgtacgccgtggccacgaccatcatcacccccatgatgcgccacaccatcgagaacacgaccgcgaacatctccctgaccgccatcgccaaccaggccgcgatcctcatggggctggacaagggctggccgatcagcaagatggacatcggcgtgcccctgctcgccctggggtgctactcccaggtcaaccccctgaccctcacggccgccgtgctgatgctggtggcccactacgcgatcatcggccccgggctccaggccaaggccacccgggaggcccagaagcgcaccgccgcgggcatcatgaagaacccgaccgtcgacgggatcgtggccatcgacctggaccccgtggtctacgacgccaagttcgagaagcagctgggccagatcatgctcctgatcctgtgcacgagccagatcctcctgatgcgcaccacctgggccctgtgcgagtccatcaccctcgccacgggccccctgaccaccctgtgggaggggagccccggcaagttctggaacaccacgatcgcggtgagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctcagcaagtccgagttcaacacctacaagcggagcgggatcatggaggtggaccgctccgaggccaaggagggcctgaagcgcggggagacgaccaagcacgccgtcagccgcggcaccgccaagctgcggtggttcgtggagcgcaacctcgtgaagccggaggggaaggtcatcgacctgggctgcggccgcggcgggtggtcctactactgcgcggggctgaagaaggtgaccgaggtgaaggggtacacgaagggcgggcccggccacgaggagcccatccccatggccacctacgggtggaacctggtcaagctccacagcggcaaggacgtgttcttcgtgccgcccgagaagtgcgacaccctgctgtgcgacatcggggagtccagccccaaccccaccatcgaggagggccgcacgctccgggtcctgaagatggtggagccgtggctgcgcgggaaccagttctgcatcaagatcctcaacccctacatgccctccgtggtcgagaccctggagcagatgcagcggaagcacggcggcatgctggtgcgcaaccccctcagccggaactccacccacgagatgtactgggtgagctgcgggaccggcaacatcgtctccgccgtgaacatgacgagccgcatgctgctgaaccggttcaccatggcccaccgcaagccgacctacgagcgcgacgtggacctcggggccggcacccggcacgtcgcggtggagcccgaggtggccaacctggacatcatcggccagcgcatcgagaacatcaagcacgagcacaagtccacctggcactacgacgaggacaacccctacaagacgtgggcctaccacgggagctacgaggtcaagcccagcggctccgccagctccatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggcgaagcgggggacggcccagatcatggaggtcaccgccaagtggctgtggggcttcctgagccgcaacaagaagccgcggatctgcacccgcgaggagttcacccggaaggtgcgctccaacgccgcgatcggcgccgtgttcgtcgacgagaaccagtggaacagcgccaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggcgaaggggtcccgggccatctggtacatgtggctcggcgcccgcttcctggagttcgaggccctgggcttcatgaacgaggaccactggttcagccgggagaactccctcagcggggtggagggcgaggggctgcacaagctgggctacatcctccgcgacatctccaagatcagcgggggcaacatgtacgccgacgacaccgcgggctgggacacccggatcaccgaggacgacctgcagaacgaggccaagatcacggacatcatggagcccgagcacgccctgctcgccaagtccatcttcaagctgacctaccagaacaaggtggtccgcgtgcagcggcccgccaagaacgggaccgtgatggacgtcatcagccgccgcgaccagcggggctccggccaggtgggcacctacggcctgaacacgttcaccaacatggaggcgcagctcatccgccagatggagagcgaggggatcttctccccgagcgagctggagacccccaacctggccgagcgggccctcgactggctggagaagcacggcgtggagcgcctgaagcggatggccatcagcggggacgactgcgtcgtgaagcccatcgacgaccgcttcgccaccgcgctcacggccctgaacgacatgggcaaggtgcggaaggacatcccccagtgggagccgtccaaggggtggaacgactggcagcaggtccccttctgcagccaccacttccaccagctgatcatgaaggacggccgcgagatcgtggtgccctgccggaaccaggacgagctcgtcggccgcgcccgggtgtcccagggggccggctggagcctgcgcgagaccgcgtgcctggggaagtcctacgcccagatgtggcagctcatgtacttccaccggcgcgacctgcggctggccgccaacgccatctgcagcgcggtgcccgtcgactgggtgccgacctcccgcaccacgtggagcatccacgcccaccaccagtggatgaccaccgaggacatgctctccgtgtggaaccgggtctggatcgaggagaacccctggatggaggacaagacccacatcagctcctgggaggacgtgccctacctgggcaagcgcgaggaccagtggtgcgggagcctgatcggcctcacggcccgggccacctgggccaccaacatccaggtggcgatcaaccaggtccgccgcctgatcggcaacgagaactacctggactacatgacctccatgaagcggttcaagaacgagagcgaccccgagggggccctctggtga

SEQ ID NO: 8005 - RNA, 9879 nt, synthetic construct
  misc_feature 1..9879: note = derived and/or modified CDS sequence (opt1) from DENV-1__GU131925__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctgcgggacagctacacccaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggccgtgttcctgctcctgatcatggggcagctgacgtggaacgacctcatccgcctgtgcatcatggtgggcgcgaacgccagcgaccgcatggggatgggcaccacctacctggccctcatggccaccttcaagatgcggccgatgttcgccgtcgggctgctgttccgccggctcacgtcccgcgaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcgtgctacgtgatcagcgggtccagcgccgacctctccctggagaaggccgccgaggtcagctgggaggaggaggccgagcactccggcgcgagccacaacatcctggtggaggtgcaggacgacgggaccatgaagatcaaggacgaggagcgggacgacaccctcaccatcctgctgaaggccaccctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacccggggcgcggtgctgatgtaccaggggaagcgcctggagcccagctgggcctccgtcaagaaggacctcatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgcgaggggaagatcgtgggcctctacggcaacggggtggtcaccaccagcggcacctacgtgagcgccatcgcccaggccaaggcgtcccaggaggggccgctgcccgagatcgaggacgaggtgttccggaagcgcaacctgacgatcatggacctccaccccggcagcgggaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctcaaggacgggcccgagcgcgtgatcctggccggccccatgccggtcacggtggcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggacgaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtcatgctccacaacagcgagcagggcgggcgggcgtaccgccacgccatggaggagctgcccgacaccatcgagacgctgatgctcctggccctgatcgccgtgctcaccggcggggtgaccctgttcttcctgtccggccgggggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccgccagcggacgccccaggacaaccagctcgcctacgtggtgatcgggctgctgttcatgatcctcacggtcgccgcgaacgagatgggcctgctggagaccaccaagaaggacctcgggatcggccacgtggccgtggggaaccaccaccacgccgccatgctggacgtcgacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtgcccctgctggccctcggctgctacagccaggtcaaccccctgaccctgacggcggccgtgctcatgctggtggcccactacgccatcatcgggccgggcctgcaggccaaggcgacccgcgaggcccagaagcggaccgccgccgggatcatgaagaaccccaccgtcgacggcatcgtggccatcgacctcgaccccgtggtctacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtggaccgcagcgaggcgaaggaggggctcaagcggggcgagacgaccaagcacgccgtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacacgaagggcggccccgggcacgaggagcccatcccgatggccacctacggctggaacctggtcaagctgcactccgggaaggacgtgttcttcatcccgcccgagaagtgcgacaccctcctgtgcgacatcggcgagagctcccccaacccgaccatcgaggaggggcgcacgctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccggaacagcacccacgagatgtactgggtgtcctgcggcaccgggaacatcgtgagcgcggtcaacatgacctcccgcatgctcctgaaccgcttcacgatggcccaccggaagcccacctacgagcgcgacgtggacctgggcgccggcacccggcacgtggccgtcgagcccgaggtggccaacctcgacatcatcgggcagcgcatcgagaacatcaagcacgagcacaagagcacctggcactacgacgaggacaacccctacaagacgtgggcgtaccacggctcctacgaggtgaagccgagcgggtccgccagcagcatggtcaacggcgtggtcaagctgctgaccaagccctgggacgtgatccccatggtgacccagatcgccatgaccgacacgacccccttcgggcagcagcgggtcttcaaggagaaggtggacacccgcaccccgaaggccaagcggggcacggcccagatcatggaggtgaccgcgaagtggctctggggcttcctgtcccgcaacaagaagccccggatctgcacccgcgaggagttcacccggaaggtccgcagcaacgccgccatcggggccgtgttcgtggacgagaaccagtggaactccgcgaaggaggccgtcgaggacgagcggttctgggacctggtgcaccgcgagcgggagctccacaagcagggcaagtgcgccacgtgcgtgtacaacatgatggggaagcgcgagaagaagctgggcgagttcgggaaggccaagggcagccgggccatctggtacatgtggctgggcgcgcgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgccgacgacaccgccgggtgggacacccggatcaccgaggacgacctccagaacgaggcccgcatcacggacatcatggagccggagcacgcgctgctggccaagtccatcttcaagctcacctaccagaacaaggtggtgcgcgtccagcggcccgccaagaacggcaccgtgatggacgtgatcagccgccgggaccagcgcgggtccggccaggtcggcacctacgggctgaacacgttcaccaacatggaggcccagctgatccggcagatggagagcgagggcatcttctcccccagcgagctcgagacccccaacctggccgagcgcgtgctggactggctcgagaagtacggggtggagcggctgaagcgcatggcgatctccggcgacgactgcgtcgtgaagccgatcgacgaccggttcgccaccgccctgacggccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcccgcgtgagccagggcgcggggtggagcctccgggagaccgcctgcctgggcaagtcctacgcccagatgtggcagctgatgtacttccaccgccgggacctccgcctggccgcgaacgccatctgcagcgccgtgcccgtcgactggatccccacctcccggaccacgtggagcatccacgcccaccaccagtggatgaccaccgaggacatgctgtccgtgtggaaccgcgtgtggatcgaggagaacccctggatggaggacaagacccacatcagctcctggggcgacgtcccgtacctcggcaagcgcgaggaccagtggtgcggcagcctgatcgggctgacggcccgggcgacctgggccaccaacatccaggtggccatcaaccaggtgcgccggctcatcggcaacgagaactacctggactacatgacctccatgaagcgcttcaagaacgagagcgaccccgagggggccctgtggtga

SEQ ID NO: 8006 - RNA, 9879 nt, synthetic construct
  misc_feature 1..9879: note = derived and/or modified CDS sequence (opt1) from DENV-1__GU131926__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccggatcagcgaggccgagcccgacgacgtggactgctggtgcaacgccaccgacacctgggtgacctacgggacctgctcccagaccggcgagcaccggcgcgacaagcggagcgtggccctggcgccccacgtgggcctcgggctggagacccggacggagacctggatgtccagcgagggcgcctggaagcagatccagcgggtcgagacctgggccctgcgccaccccgggttcaccgtgatcgccctcttcctggcgcacgccatcggcacgtccatcacccagaaggggatcatcttcatcctgctcatgctggtgacccccagcatggccatgcggtgcgtcggcatcggctcccgcgacttcgtggaggggctgagcggcgccacctgggtggacgtcgtgctcgagcacgggtcctgcgtgacgaccatggccaaggacaagcccaccctggacatcgagctgctcaagaccgaggtcacgaaccccgcggtgctgcggaagctgtgcatcgaggccaagatcagcaacaccaccaccgactcccgctgcccgacgcagggcgaggccaccctcgtggaggagcaggacgccaacttcgtctgccggcgcaccttcgtggaccggggctgggggaacggctgcgggctgttcggcaaggggagcctgatcacgtgcgccaagttcaagtgcgtgacgaagctcgagggcaagatcgtccagtacgagaacctgaagtactccgtgatcgtgaccgtccacaccggcgaccagcaccaggtggggaacgagagcaccgagcacggcacgaccgcgaccatcacgccccaggccccctccaccgagatccagctgacggactacggggccctcaccctggactgcagcccccgcaccggcctggacttcaacgagatggtcctcctgaccatgaaggagaagtcctggctggtgcacaagcagtggttcctcgacctgccgctgccctggacgtccggggccagcacctcccaggagacctggaaccggcaggacctcctggtgaccttcaagacggcccacgcgaagaagcaggaggtcgtggtgctgggcagccaggagggcgccatgcacaccgccctcaccggggccaccgagatccagacgtccggcaccaccaccatcttcgccgggcacctgaagtgccgcctgaagatggacaagctcacgctgaagggcatgagctacgtcatgtgcaccgggtccttcaagctggagaaggaggtggcggagacccagcacggcaccgtgctcgtccagatcaagtacgagggcacggacgccccctgcaagatccccttcagcacccaggacgagaagggggtgacccagaacggccggctgatcaccgccaacccgatcgtgacggacaaggagaagcccgtcaacatcgaggccgagccgcccttcggggagtcctacatcgtgatcggcgcgggcgagaaggccctgaagctgagctggttcaagaaggggtccagcatcggcaagatgttcgaggccaccgcccgcggggcccggcgcatggcgatcctcggcgacaccgcctgggacttcgggtccatcggcggcgtgttcaccagcgtcgggaagctggtgcaccagatcttcggcacggcctacggggtgctgttctccggcgtcagctggaccatgaagatcgggatcggcgtgctcctgacctggctgggcgtgaactcccgcagcacctccctcagcatgacgtgcatcgccgtcgggctggtgaccctgtacctcggcgtgatggtccaggccgacagcgggtgcgtgatcaactggaagggccgggagctgaagtgcgggtccggcatcttcgtgaccaacgaggtccacacctggacggagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcaccgtggtcgtgggggacgtggcgggcatcctggcccaggggaagaagatgatccggccccagcccatggagtacaagtacagctggaagtcctggggcaaggccaagatcatcggcgccgacgtccagaacaccaccttcatcatcgacgggcccaacacgccggagtgccccgacgaccagcgcgcgtggaacatctgggaggtggaggactacggcttcgggatcttcaccaccaacatctggctgaagctccgggacagctacacccaggtgtgcgaccaccgcctgatgtccgccgccatcaaggacagcaaggccgtccacgccgacatgggctactggatcgagtccgagaagaacgagacgtggaagctggcgcgggccagcttcatcgaggtgaagacctgcatctggcccaagtcccacaccctctggagcaacggcgtgctggagtccgagatgatcatccccaagatctacgggggcccgatcagccagcacaactaccgccccgggtacttcacccagacggccggcccctggcacctggggaagctcgagctggacttcgacctgtgcgagggcaccaccgtcgtggtggacgagcactgcggcaaccgggggccgtccctccgcaccacgaccgtcaccggcaagatcatccacgagtggtgctgccggagctgcaccctgccgcccctgcgcttcaagggggaggacggctgctggtacgggatggagatccggcccgtgaaggagaaggaggagaacctcgtcaagagcatggtctccgccggcagcggcgaggtggactccttcagcctggggctgctctgcatctccatcatgatcgaggaggtgatgcgcagccggtggtcccgcaagatgctgatgacgggcaccctggccgtcttcttcctcctgatcatggggcagctgacctggaacgacctcatccggctgtgcatcatggtgggcgcgaacgccagcgaccgcatggggatgggcatgacctacctggccctcatggccacgttcaagatgcgcccgatgttcgccgtgggcctgctgttccggcgcctcacctcccgggaggtcctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcctggaagacgatggcgatggtgctcagcatcgtgtccctgttccccctgtgcctcagcaccacctcccagaagaccacgtggctgcccgtcctgctcggcagcctggggtgcaagccgctgaccatgttcctcatcgccgagaacaagatctggggccgcaagagctggcccctgaacgaggggatcatggccgtgggcatcgtgtccatcctgctcagctccctgctgaagaacgacgtccccctcgccgggcccctgatcgccggcggcatgctgatcgcgtgctacgtgatcagcgggtccagcgccgacctctccctggagaaggccgccgaggtgagctgggaggaggaggccgagcactccggcgcgagccacaacatcctggtcgaggtgcaggacgacgggaccatgaagatcaaggacgaggagcgggacgacaccctcacgatcctgctgaaggccaccctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacgcggggcgcggtgctgatgtaccaggggaagcgcctggagcccagctgggcctccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgagcgagggcgaggtgggcgccatcgcgctggacttcaagcccgggaccagcggctcccccatcgtgaaccgcgaggggaagatcgtcggcctctacggcaacggggtggtgaccaccagcggcacgtacgtctccgccatcgcccaggccaaggcgagccaggaggggcccctgccggagatcgaggacgaggtgttccggaagcgcaacctgaccatcatggacctccaccccggctccgggaagacccggcgctacctgcccgccatcgtgcgggaggccatcaagcgcaagctgcggaccctcatcctggccccgacgcgcgtcgtggccagcgagatggcggaggccctgaagggcatgcccatccgctaccagaccaccgccgtgaagtccgagcacaccggcaaggagatcgtcgacctcatgtgccacgccacgttcaccatgcggctgctgagccccgtgcgcgtgcccaactacaacatgatcatcatggacgaggcccacttcaccgacccgtccagcatcgcggcccgggggtacatctccacccgcgtcggcatgggggaggccgccgccatcttcatgacggcgacgccgcccggcagcgccgaggccttcccccagtccaacgccgtgatccaggacgaggagcgggacatcccggagcgcagctggaactccgggtacgagtggatcaccgacttccccggcaagaccgtgtggttcgtccccagcatcaagtccggcaacgacatcgcgaactgcctccggaagaacgggaagcgcgtgatccagctgagccggaagacgttcgacaccgagtaccagaagaccaagaacaacgactgggactacgtggtcaccacggacatctccgagatgggcgccaacttccgcgccgaccgggtgatcgacccccgccggtgcctgaagccggtgatcctcaaggacgggcccgagcgcgtcatcctggccggccccatgcccgtgaccgtcgccagcgcggcccagcggcgcgggcggatcggccgcaaccacaacaaggagggcgaccagtacatctacatggggcagccgctgaacaacgacgaggaccacgcccactggaccgaggccaagatgctcctggacaacatcaacacccccgagggcatcatccccgccctgttcgagcccgagcgggagaagtccgcggccatcgacggggagtaccgcctccgcggcgaggcccggaagacgttcgtggagctgatgcgccgcggggacctgccggtgtggctctcctacaaggtcgccagcgagggcttccagtactccgaccgccggtggtgcttcgacggcgagcgcaacaaccaggtgctggaggagaacatggacgtggagatctggaccaaggagggggagcggaagaagctgcgcccccggtggctcgacgcccgcacctacagcgaccccctggcgctgcgggagttcaaggagttcgccgccggccgccggtccgtcagcggggacctcatcctggagatcggcaagctgccccagcacctcacccagcgcgcccagaacgcgctggacaacctggtgatgctccacaactccgagcagggcgggcgggcctaccgccacgccatggaggagctgccggacacgatcgagaccctgatgctcctggccctgatcgccgtgctcaccggcggggtcaccctgttcttcctgagcggccgggggctcggcaagacgtccatcggcctgctgtgcgtgatggcgagctccgtgctcctgtggatggccagcgtcgagccccactggatcgccgcctccatcatcctggagttcttcctcatggtgctgctgatccccgagcccgaccgccagcggaccccgcaggacaaccagctcgcctacgtggtcatcgggctgctgttcatgatcctcaccgtggcggccaacgagatgggcctgctggagaccaccaagaaggacctcgggatcggccacgtggccgtcgagaaccaccaccacgccgccatgctggacgtggacctgcaccccgcgagcgcctggacgctctacgccgtggccaccaccatcatcacccccatgatgcgccacacgatcgagaacaccaccgccaacatctccctgaccgcgatcgccaaccaggccgccatcctgatggggctcgacaagggctggccgatcagcaagatggacatcggcgtccccctgctggcgctcgggtgctactcccaggtgaaccccctgacgctgaccgccgccgtgctcatgctggtcgcccactacgccatcatcggccccgggctgcaggcgaaggccacccgggaggcccagaagcgcaccgccgccggcatcatgaagaacccgacggtggacgggatcgtggcgatcgacctcgaccccgtcgtgtacgacgccaagttcgagaagcagctgggccagatcatgctgctcatcctgtgcaccagccagatcctgctcatgcgcaccacctgggccctgtgcgagtccatcacgctggccaccggccccctcaccaccctgtgggaggggagccccggcaagttctggaacacgaccatcgccgtgagcatggcgaacatcttccgggggtcctacctggccggcgccggcctcgccttcagcctgatgaagtccctcgggggcgggcgccgggggaccggggcgcagggcgagaccctcggcgagaagtggaagcgccagctgaaccagctgagcaagtccgagttcaacacgtacaagcggagcgggatcatggaggtcgaccgctccgaggccaaggagggcctcaagcgcggggagaccaccaagcacgccgtgagccgcggcaccgccaagctgcggtggttcgtggagcgcaacctggtcaagccggaggggaaggtgatcgacctcggctgcggccgcggcgggtggtcctactactgcgccgggctgaagaaggtgacggaggtcaaggggtacaccaagggcggccccggccacgaggagcccatccccatggcgacctacgggtggaacctggtgaagctgcacagcggcaaggacgtgttcttcgtcccgcccgagaagtgcgacaccctcctgtgcgacatcggggagtccagccccaaccccacgatcgaggagggccgcaccctgcgggtgctcaagatggtggagccgtggctgcgcgggaaccagttctgcatcaagatcctgaacccctacatgccctccgtcgtggagaccctcgagcagatgcagcggaagcacggcggcatgctggtgcgcaaccccctgagccggaactccacccacgagatgtactgggtcagctgcgggacgggcaacatcgtgtccgccgtgaacatgaccagccgcatgctcctgaaccggttcaccatggcccaccgcaagccgacctacgagcgcgacgtcgacctgggggccggcacccggcacgtggccgtggagcccgaggtcgcgaacctcgacatcatcggccagcgcatcgagaacatcaagcacgagcacaagtccacgtggcactacgacgaggacaacccctacaagacctgggcctaccacgggagctacgaggtgaagcccagcggctccgccagctccatggtcaacggggtggtgaagctgctgaccaagccgtgggacgtcatccccatggtgacccagatcgccatgacggacaccacccccttcggccagcagcgggtgttcaaggagaaggtcgacacccgcacgcccaaggccaagcgggggaccgcgcagatcatggaggtgaccgccaagtggctctggggcttcctgagccgcaacaagaagccgcggatctgcacccgcgaggagttcacgcggaaggtgcgctccaacgccgccatcggcgcggtcttcgtggacgagaaccagtggaacagcgccaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggtcccgggcgatctggtacatgtggctgggcgcccgcttcctcgagttcgaggccctgggcttcatgaacgaggaccactggttcagccgggagaactccctgagcggggtggagggcgaggggctccacaagctgggctacatcctgcgcgacatctccaagatcagcgggggcaacatgtacgccgacgacaccgccggctgggacacccggatcacggaggacgacctccagaacgaggcgaagatcaccgacatcatggagcccgagcacgccctgctggccaagtccatcttcaagctcacctaccagaacaaggtcgtgcgcgtgcagcggcccgccaagaacgggaccgtcatggacgtgatcagccgccgcgaccagcggggctccggccaggtgggcacgtacggcctgaacaccttcaccaacatggaggcccagctgatccgccagatggagagcgaggggatcttctccccgagcgagctcgagacccccaacctggcggagcgggccctggactggctcgagaagcacggcgtcgagcgcctgaagcggatggccatcagcggggacgactgcgtggtgaagcccatcgacgaccgcttcgccacggccctgaccgcgctcaacgacatgggcaaggtccggaaggacatcccccagtgggagccgtccaaggggtggaacgactggcagcaggtccccttctgcagccaccacttccaccagctgatcatgaaggacggccgcgagatcgtggtcccctgccggaaccaggacgagctggtgggccgcgcccgggtgtcccagggggccggctggagcctccgcgagaccgcctgcctggggaagtcctacgcgcagatgtggcagctgatgtacttccaccggcgcgacctccggctggccgccaacgccatctgcagcgccgtccccgtggactgggtgccgacctcccgcacgacctggagcatccacgcgcaccaccagtggatgaccaccgaggacatgctgtccgtctggaaccgggtgtggatcgaggagaacccctggatggaggacaagacgcacatcagctcctgggaggacgtgccctacctcggcaagcgcgaggaccagtggtgcgggagcctgatcggcctgaccgcccgggccacctgggccaccaacatccaggtcgccatcaaccaggtgcgccgcctcatcggcaacgagaactacctggactacatgacgtccatgaagcggttcaagaacgagagcgaccccgagggggcgctgtggtga

SEQ ID NO: 8007 - RNA, 9879 nt, synthetic construct
  misc_feature 1..9879: note = derived and/or modified CDS sequence (opt1) from DENV-1__FJ639669__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctccgggacagctacacccaggtgtgcgaccaccgcctgatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtcgtggacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcaccctggccgtgttcttcctcctgatcatggggcagctgacgtggaacgacctcatccgcctgtgcatcatggtcggcgcgaacgccagcgaccgcatggggatgggcaccacctacctggccctcatggccaccttcaagatgcggccgatgttcgccgtgggcctgctgttccgccggctcacgtcccgcgaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtcctcagcatcgtgtccctgttccccctgtgcctcagcacgacctcccagaagaccacctggctgcccgtgctgctcggcagcctggggtgcaagccgctgacgatgttcctcatcgccgagaacaagatctggggccggaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacaccctcaccatcctgctgaaggccaccctcctggccgtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacaccatgtggcacgtgacccgcggcgcggtcctgatgtaccaggggaagcggctggagcccagctgggcctccgtgaagaaggacctcatcagctacggcggcgggtggcgcctgcagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctctacggcaacggggtcgtgaccaccagcggcacctacgtgagcgccatcgcccaggccaaggcgtcccaggaggggccgctgcccgagatcgaggacgaggtcttccgcaagcggaacctgacgatcatggacctccaccccggcagcgggaagacccgccggtacctgccggccatcgtgcgcgaggccatcaagcggaagctgcgcaccctcatcctggcccccacccgcgtggtcgcctccgagatggcggaggccctgaagggcatgcccatccggtaccagacgaccgccgtcaagagcgagcacaccggcaaggagatcgtggacctcatgtgccacgccaccttcacgatgcgcctgctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctcaaggacgggcccgagcgggtcatcctggccggccccatgccggtgacggtcgcctccgccgcgcagcgccgggggcgcatcggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccgcctccggggcgaggcccgcaagaccttcgtggagctgatgcggcgcggggacctgcccgtgtggctctcctacaaggtcgccagcgagggcttccagtacagcgaccggcgctggtgcttcgacggcgagcggaacaaccaggtgctggaggagaacatggacgtggagatctggacgaaggagggggagcgcaagaagctgcggccccgctggctcgacgcccggacctactccgaccccctggccctgcgcgagttcaaggagttcgcggccggccggcgcagcgtctccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtgctcaccggcggggtcaccctgttcttcctgtccggccgcgggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagccggaccggcagcgcacgccccaggacaaccagctcgcctacgtggtcatcgggctgctgttcatgatcctcacggtggccgcgaacgagatgggcctgctggagaccaccaagaaggacctcgggatcggccacgtggccgtcgagaaccaccaccacgccgccatgctggacgtggacctgcaccccgcctccgcgtggaccctctacgccgtggccacgaccatcatcaccccgatgatgcggcacaccatcgagaacacgaccgccaacatcagcctgaccgccatcgcgaaccaggccgccatcctgatggggctcgacaagggctggcccatctccaagatggacatcggcgtccccctgctggccctcgggtgctacagccaggtgaaccccctgaccctgacggcggccgtgctcatgctggtcgcccactacgccatcatcggcccggggctgcaggccaaggcgacccgcgaggcccagaagcgcaccgccgccggcatcatgaagaaccccaccgtggacgggatcgtggccatcgacctcgaccccgtcgtgtacgacgcgaagttcgagaagcagctgggccagatcatgctgctcatcctgtgcacgtcccagatcctgctcatgcggaccacctgggccctgtgcgagagcatcaccctggccacgggccccctcaccaccctgtgggaggggtccccgggcaagttctggaacaccacgatcgccgtgagcatggccaacatcttccgcgggtcctacctggcgggcgccggcctcgccttcagcctgatgaagtccctcgggggcgggcggcgcgggaccggggcccagggcgagaccctcggcgagaagtggaagcggcagctgaaccagctgtccaagagcgagttcaacacctacaagcgctccgggatcatggaggtcgaccggagcgaggcgaaggagggcctcaagcgcggggagacgaccaagcacgccgtgtcccggggcaccgccaagctgcgctggttcgtggagcggaacctggtcaagcccgaggggaaggtgatcgacctgggctgcggccgcgggggctggagctactactgcgccgggctcaagaaggtgaccgaggtcaagggctacacgaagggcgggcccggccacgaggagcccatcccgatggccacctacgggtggaacctggtgaagctgcactccggcaaggacgtgttcttcatcccgcccgagaagtgcgacaccctcctgtgcgacatcggggagagctcccccaacccgaccatcgaggagggccggacgctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacccacgagatgtactgggtgtcctgcgggaccggcaacatcgtcagcgcggtgaacatgacctcccggatgctcctgaaccgcttcacgatggcccaccgcaagcccacctacgagcgggacgtggacctggggaccggcacccgccacgtcgccgtggagcccgaggtggccaacctcgacatcatcggccagcggatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctgctgaccaagccctgggacgtgatccccatggtcacccagatcgccatgacggacaccacccccttcggccagcagcgcgtgttcaaggagaaggtggacacccggacgccgaaggccaagcgcgggaccgcccagatcatggaggtcaccgcccggtggctctggggcttcctgtcccgcaacaagaagccccggatctgcacccgcgaggagttcacgcggaaggtgcgcagcaacgcggccatcggcgccgtgttcgtcgacgagaaccagtggaactccgccaaggaggcggtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggccaagatcaccgacatcatggagccggagcacgccctgctggcgaaggccatcttcaagctcacctaccagaacaaggtggtccgcgtgcagcgccccgccaagaacgggaccgtgatggacgtcatctcccggcgcgaccagcggggcagcggccaggtggggacgtacggcctgaacaccttcaccaacatggaggcccagctgatccgccagatggagtccgaggggatcttcagcccctccgagctcgagacccccaacctggccgagcgggcgctggactggctcgagaagtacggcgtggagcgcctgaagcggatggccatcagcggggacgactgcgtcgtgaagccgatcgacgaccgcttcgccacggccctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtggtgccgtgccggaaccaggacgagctggtcggccgcgcgcgggtgtcccagggggccggctggagcctccgcgagaccgcctgcctgggcaagagctacgcccagatgtggcagctgatgtacttccaccggcgcgacctccggctggcggccaacgccatctgctccgccgtgcccgtcgactgggtgcccaccagccgcacgacctggtccatccacgcccaccaccagtggatgaccaccgaggacatgctgagcgtgtggaaccgggtctggatcgaggagaacccctggatggaggacaagacgcacatctccagctgggaggacgtgccgtacctcggcaagcgcgaggaccagtggtgcgggtccctgatcggcctgaccgcgcgcgccacctgggccaccaacatccaggtggccatcaaccaggtccggcgcctcatcggcaacgagaactacctggactacatgaccagcatgaagcggttcaagaacgagtccgaccccgagggggccctgtggtga

SEQ ID NO: 8008 - RNA, 9882 nt, synthetic construct
  misc_feature 1..9882: note = derived and/or modified CDS sequence (opt1) from DENV-1__FJ639670__SS-prME
  source 1..9882: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggcccaggggaagaagatgatccggccccagcccatggagtacaagtacagctggaagtcctggggcaaggccaagatcatcggcgccgacgcgcagaacacgaccttcatcatcgacgggcccaacaccccggagtgccccgacgaccagcgcgcctggaacatctgggaggtggaggactacggcttcgggatcttcaccacgaacatctggctgaagctccgggacagctacacccaggtctgcgaccaccgcctgatgtccgccgccatcaaggacagcaaggccgtgcacgcggacatgggctactggatcgagtccgagaagaacgagacctggaagctggcccgggccagcttcatcgaggtgaagacctgcatctggcccaagtcccacacgctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtggtcgacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcaccctggcggtgttcttcctcctgatcatggggcagctgacgtggaacgacctcatccgcctgtgcatcatggtgggcgccaacgccagcgaccgcatggggatgggcaccacctacctggccctcatggccaccttcaagatgcggccgatgttcgcggtcggcctgctgttccgccggctcacgtcccgcgaggtgctgctgctcaccatcgggctgagcctggtggcctccgtcgagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcgtggaagaccatggccatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggccggaagtcctggcccctgaacgaggggatcatggccgtgggcatcgtcagcatcctgctcagctccctgctgaagaacgacgtgcccctcgccgggcccctgatcgcgggcggcatgctgatcgcctgctacgtgatcagcgggtccagcgccgacctctccctggagaaggccgccgaggtcagctgggaggaggaggcggagcactccggcgccagccacaacatcctggtggaggtgcaggacgacgggaccatgaagatcaaggacgaggagcgcgacgacaccctcaccatcctgctgaaggccaccctcctggccgtctccggcgtgtacccgctgagcatccccgccaccctcttcgtgtggtacttctggcagaagaagaagcagcggtccggggtcctgtgggacacccccagcccgcccgaggtggagcgcgcggtgctggacgacggcatctaccggatcatgcagcgcggcctgctcgggcggtcccaggtcggcgtgggggtgttccaggagaacgtcttccacaccatgtggcacgtgacccgcggcgccgtgctgatgtaccaggggaagcggctggagcccagctgggcctccgtcaagaaggacctcatcagctacggcggcgggtggcgcctgcagggctcctggaacacgggggaggaggtccaggtgatcgccgtcgagcccggcaagaaccccaagaacgtgcagaccgcccccgggaccttcaagacccccgagggcgaggtgggcgcgatcgccctggacttcaagcccgggacgagcggctcccccatcgtcaaccgggaggggaagatcgtgggcctctacggcaacggggtggtcaccaccagcggcacctacgtgagcgccatcgcccaggcgaaggcctcccaggaggggccgctgcccgagatcgaggacgaggtgttccgcaagcggaacctgacgatcatggacctccaccccggcagcgggaagacccgccggtacctgccggccatcgtccgcgaggccatcaagcggaagctgcgcaccctcatcctggcccccacccgcgtggtggcgtccgagatggccgaggccctgaagggcatgcccatccggtaccagacgaccgccgtcaagagcgagcacaccggcaaggagatcgtggacctcatgtgccacgccaccttcacgatgcgcctgctgtcccccgtgcgggtcccgaactacaacatgatcatcatggacgaggcgcacttcaccgaccccagctccatcgccgcccgcgggtacatcagcacccgggtgggcatgggggaggccgccgcgatcttcatgaccgccacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgcgaactgcctccgcaagaacgggaagcgggtcatccagctgtcccgcaagaccttcgacacggagtaccagaagaccaagaacaacgactgggactacgtggtgaccaccgacatcagcgagatgggcgccaacttccgggccgaccgcgtcatcgacccgcggcgctgcctgaagcccgtgatcctcaaggacgggcccgagcgggtgatcctggccggccccatgccggtcacggtggcctccgcggcccagcgccgggggcgcatcggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgcggccatcgacggggagtaccgcctccggggcgaggcccgcaagaccttcgtcgagctgatgcggcgcggggacctgcccgtgtggctctcctacaaggtggccagcgagggcttccagtacagcgaccggcgctggtgcttcgacggcgagcggaacaaccaggtcctggaggagaacatggacgtggagatctggacgaaggagggggtgtcccgcaagaacctgcggccccgctggctcgacgcccggacctacagcgaccccctggcgctgcgcgagttcaaggagttcgccgccggccggcgctccgtcagcggggacctcatcctggagatcggcaagctgccgcagcacctcacccagcgggcccagaacgcgctggacaacctggtgatgctccacaactccgagcagggcgggcgcgcctaccggcacgccatggaggagctgcccgacaccatcgagacgctgatgctcctggccctgatcgccgtgctcaccggcggggtcaccctgttcttcctgagcggccgcgggctcggcaagacctccatcggcctgctgtgcgtgatggcgagctccgtgctcctgtggatcgccagcgtcgagccccactggatcgccgcctccatcatcctggagttcttcctcatggtgctgctgatccccgagccggaccggcagcgcacgccccaggacaaccagctcgcctacgtggtcatcgggctgctgttcatgatcctcacggtggcggccaacgagatgggcctgctggagaccaccaagaaggacctcgggatcggccacgtggccgtcgagaaccaccaccacgccgccatgctggacgtggacctgcaccccgcgagcgcctggaccctctacgccgtggccacgaccatcatcaccccgatgatgcggcacaccatcgagaacacgaccgccaacatctccctgaccgcgatcgccaaccaggccgccatcctgatggggctcgacaagggctggcccatcagcaagatggacatcggcgtccccctgctggcgctcgggtgctactcccaggtgaaccccctgaccctgacggccgccgtgctcatgctggtcgcccactacgccatcatcggcccggggctgcaggcgaaggccacccgcgaggcccagaagcgcaccgccgccggcatcatgaagaaccccaccgtggacgggatcgtggcgatcgacctcgaccccgtcgtgtacgacgccaagttcgagaagcagctgggccagatcatgctgctcatcctgtgcacgagccagatcctgctcatgcggaccacctgggccctgtgcgagtccatcaccctggccacgggccccctcaccaccctgtgggaggggagcccgggcaagttctggaacaccacgatcgccgtgtccatggcgaacatcttccgcgggagctacctggccggcgccggcctcgccttcagcctgatgaagtccctcgggggcgggcggcgcgggaccggggcgcagggcgagaccctcggcgagaagtggaagcggcagctgaaccagctgagcaagtccgagttcaacacctacaagcgcagcgggatcatggaggtcgaccggtccgaggccaaggagggcctcaagcgcggggagacgaccaagcacgccgtgagccggggcaccgccaagctgcgctggttcgtggagcggaacctggtcaagcccgaggggaaggtgatcgacctgggctgcggccgcgggggctggtcctactactgcgccgggctcaagaaggtgaccgaggtcaagggctacacgaagggcgggcccggccacgaggagcccatcccgatggcgacctacgggtggaacctggtgaagctgcacagcggcaaggacgtgttcttcatcccgcccgagaagtgcgacaccctcctgtgcgacatcggggagtccagctccaaccccaccatcgaggagggccggacgctgcgcgtcctcaagatggtggagccgtggctgcgggggaaccagttctgcatcaagatcctgaacccctacatgcccagcgtggtcgagaccctcgagcagatgcagcgcaagcacggcggcatgctggtgcggaaccccctgtcccgcaacagcacccacgagatgtactgggtgtcctgcgggaccggcaacatcgtcagcgccgtgaacatgacctcccggatgctcctgaaccgcttcacgatggcccaccgcaagccgacctacgagcgggacgtggacctggggaccggcacccgccacgtcgccgtggagcccgaggtggccaacctcgacatcatcggccagcggatcgagaacatcaagcacgagcacaagagcacgtggcactacgacgaggacaacccctacaagacctgggcgtaccacgggtcctacgaggtcaagcccagcggcagcgcctccagcatggtgaacggggtcgtgaagctgctgaccaagccgtgggacgtgatccccatggtcacccagatcgccatgacggacaccacccccttcggccagcagcgcgtgttcaaggagaaggtggacacccggacgcccaaggccaagcgcgggaccgcccagatcatggaggtcaccgcgcggtggctctggggcttcctgtcccgcaacaagaagccgcggatctgcacccgcgaggagttcacgcggaaggtgcgcagcaacgccgccatcggcgccgtgttcgtcgacgagaaccagtggaactccgcgaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggccaagatcaccgacatcatggagcccgagcacgcgctgctggccaaggccatcttcaagctcacctaccagaacaaggtggtccgcgtgcagcgcccggccaagaacgggaccgtgatggacgtcatctcccggcgcgaccagcggggcagcggccaggtggggacgtacggcctgaacaccttcaccaacatggaggcccagctgatccgccagatggagtccgaggggatcttcagcccctccgagctcgagacccccaacctggcggagcgggccctggactggctcgagaagtacggcgtggagcgcctgaagcggatggccatcagcggggacgactgcgtcgtgaagcccatcgacgaccgcttcgccacggccctgaccgcgctcaacgacatgggcaaggtgcggaaggacatcccgcagtgggagccctccaaggggtggaacgactggcagcaggtccccttctgcagccaccacttccaccagctgatcatgaaggacggccgcgagatcgtggtgccctgccggaaccaggacgagctggtcggccgcgcccgggtgagccagggggccggctggtccctccgcgagaccgcctgcctgggcaagagctacgcgcagatgtggcagctgatgtacttccaccggcgcgacctccggctggccgccaacgccatctgctccgccgtgccggtcgactgggtgcccaccagccgcacgacctggtccatccacgcgcaccaccagtggatgaccaccgaggacatgctgagcgtgtggaaccgggtctggatcgaggagaacccctggatggaggacaagacgcacatctccagctgggaggacgtgccctacctcggcaagcgcgaggaccagtggtgcgggtccctgatcggcctgaccgcccgcgccacctgggccaccaacatccaggtggccatcaaccaggtccggcgcctcatcggcaacgagaactacctggactacatgaccagcatgaagcggttcaagaacgagtccgacccggagggggcgctgtggtga

SEQ ID NO: 8009 - RNA, 9879 nt, synthetic construct
  misc_feature 1..9879: note = derived and/or modified CDS sequence (opt1) from DENV-1__FJ639671__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagctgtgcgaggacaccctcacctacaagtgcccccgcatcaccgaggtggagcccgacgacgtggactgctggtgcaacaccacggacacctgggtgacctacgggacctgcagccagacgggcgagcaccggcgcgacaagcggagcgtggccctggcgccccacgtgggcctggggctcgagacccgcgccgagacctggatgagcagcgagggcgcgtggaagcagatccagcgggtggagacctgggccctgcgccaccccgggttcacggtgatcgccctgttcctcgcccacgcgatcggcaccagcatcacccagaaggggatcatcttcatcctgctgatgctcgtcaccccctccatggccatgcggtgcgtgggcatcggcagccgcgacttcgtggaggggctgtccggcgccacgtgggtcgacgtggtgctggagcacgggagctgcgtcaccaccatggccaaggacaagcccaccctcgacatcgagctgctgaagacggaggtgaccaaccccgccgtgctccggaagctgtgcatcgaggcgaagatctccaacaccaccacggacagccgctgccccacccagggcgaggccaccctggtcgaggagcaggacgccaacttcgtgtgccggcgcaccttcgtggaccggggctgggggaacggctgcggcctgttcggcaaggggtccctgatcacgtgcgccaagttcaagtgcgtcaccaagctggagggcaagatcgtgcagtacgagaacctcaagtacagcgtgatcgtcaccgtgcacaccggcgaccagcaccaggtcgggaacgagtccacggagcacggcaccaccgccaccatcacgccccaggcgcccacgagcgagatccagctgaccgactacggggccctgaccctcgactgcagcccccggaccggcctggacttcaacgagatggtgctgctcacgatgaaggagaagtcctggctggtgcacaagcagtggttcctggacctcccgctgccctggaccagcggggcctccaccagccaggagacctggaaccggcaggacctgctcgtcacgttcaagaccgcccacgccaagaagcaggaggtggtggtcctgggctcccaggagggcgcgatgcacaccgccctgaccggggccacggagatccagaccagcggcaccaccacgatcttcgccgggcacctcaagtgccgcctgaagatggacaagctgaccctcaagggcatgtcctacgtgatgtgcaccgggagcttcaagctggagaaggaggtggccgagacccagcacggcacggtcctggtgcagatcaagtacgagggcaccgacgcgccctgcaagatccccttctccacccaggacgggaagggcgtgacccagaacgggcggctgatcacggccaacccgatcgtcaccgacaaggagaagcccgtgaacatcgaggccgagccgcccttcggcgagagctacatcgtgatcggcgccggggagaaggcgctcaagctgtcctggttcaagaagggcagctccatcgggaagatgttcgaggccaccgcccgcggcgcccggcgcatggccatcctgggggacaccgcgtgggacttcggcagcgtcggcggggtgttcacgtccgtgggcaagctcgtccaccagatcttcgggaccgcctacggcgtgctgttcagcggggtgtcctggaccatgaagatcggcatcggcgtcctgctcacctggctggggctgaacagccgctccacgagcctctccatgacctgcatcgccgtgggcctggtgaccctgtacctcggggtcatggtgcaggccgacagcggctgcgtgatcaactggaaggggcgggagctgaagtgcggcagcggcatcttcgtcaccaacgaggtgcacacgtggaccgagcagtacaagttccaggccgactccccgaagcgcctgagcgcggccatcgggaaggcctgggaggagggcgtgtgcgggatccggtccgccacccgcctcgagaacgtcatgtggcggcagatcagcaacgagctgaaccacatcctgctcgagaacgacatgaagttcaccgtggtggtcggcgacgtggtggggatcctggcccagggcaagaagatgatccgcccccagcccatggagcacaagtactcctggaagtcctggggcaaggcgaagatcatcggggccgacgtccagaacaccacgttcatcatcgacggccccaacacctccgagtgcccggacgaccagcgggcctggaacatctgggaggtggaggactacgggttcggcatcttcaccaccaacatctggctgaagctccgcgacagctacacccaggtgtgcgaccaccggctgatgtccgccgcgatcaaggacagccgcgccgtccacgccgacatgggctactggatcgagtccgagaagaacgagacctggaagctggcccgggccagcttcatcgaggtgaagacctgcatctggcccaagtcccacaccctctggagcaacggggtgctggagtccgagatgatcatccccaagatctacggcgggcccatcagccagcacaactaccgcccgggctacttcacgcagaccgcggggccctggcacctgggcaagctcgagctggacttcgacctgtgcgagggcaccaccgtcgtggtggacgagcactgcgggaaccggggcccctccctccgcacgaccaccgtcaccgggaagatcatccacgagtggtgctgccggagctgcacgctgccgcccctgcgcttcaagggcgaggacgggtgctggtacggcatggagatccggcccgtgaaggagaaggaggagaacctcgtcaagagcatggtctccgccggcagcggggaggtggactccttcagcctgggcctgctctgcatctccatcatgatcgaggaggtgatgcgcagccggtggtcccgcaagatgctgatgaccgggaccctggccgtcttcttcctcctgatcatgggccagctgacctggaacgacctcatccgcctgtgcatcatggtgggggccaacgccagcgaccggatgggcatgggcacgacgtacctggcgctcatggccaccttcaagatgcgccccatgttcgccgtcgggctgctgttccggcgcctcacctcccgggaggtgctgctgctcacgatcgggctgagcctggtggcctccgtcgagctcccgaacagcctggaggagctgggggacggcctcgccatgggcatcatgatcctgaagctgctcaccgacttccagtcctaccagctgtgggcgaccctgctcagcctgaccttcatcaagacgaccttctccctgcactacgcctggaagaccatggccatggtgctcagcatcgtgtccctgctgcccctctgcctgagcaccacgtcccagaagaccacctggctgcccgtcctcctggggagcctgggctgcaagcccctcaccatgttcctgatcgccgagaacaagatctgggggcgcaagagctggccgctgaacgagggcatcatggcggtggggatcgtgtccatcctcctgagctccctgctcaagaacgacgtccccctggccggccccctgatcgccggcgggatgctcatcgcctgctacgtgatcagcggctccagcgccgacctgtccctggagaaggcggccgaggtgagctgggaggaggaggccgagcactccggggccagccacaacatcctcgtcgaggtgcaggacgacggcacgatgaagatcaaggacgaggagcgggacgacaccctgaccatcctgctcaaggccaccctgctggcggtgtccggggtctaccccctcagcatcccggccaccctgttcgtgtggtacttctggcagaagaagaagcagcgctccggcgtgctgtgggacacgccctccccgcccgaggtcgagcgggccgtgctggacgacggcatctaccgcatcatgcagcgggggctcctgggccgctcccaggtgggggtcggcgtgttccaggagaacgtgttccacaccatgtggcacgtcacccgcggggccgtgctgatgtaccagggcaagcgcctcgagccgagctgggcctccgtgaagaaggacctgatcagctacggcgggggctggcggctgcaggggtcctggaacaccggcgaggaggtccaggtgatcgcggtggagcccgggaagaaccccaagaacgtccagacggcccccggcaccttcaagaccccggagggcgaggtgggggccatcgccctcgacttcaagcccggcaccagcgggagccccatcgtgaaccgcgagggcaagatcgtcggcctgtacgggaacggcgtggtgacgacctccgggacctacgtcagcgccatcgcgcaggccaaggcctcccaggagggccccctgccggagatcgaggacgaggtgttccggaagcgcaacctcaccatcatggacctgcaccccgggagcggcaagacgcggcgctacctgcccgccatcgtgcgggaggcgatcaagcgcaagctccgcaccctgatcctggccccgacccgggtcgtggcctccgagatggccgaggccctcaagggcatgcccatccgctaccagaccacggcggtcaagagcgagcacaccgggcgggagatcgtcgacctgatgtgccacgccaccttcaccatgcgcctgctctcccccgtgcgggtgcccaactacaacatgatcatcatggacgaggcccacttcacggacccgagctccatcgccgcccgcggctacatcagcacccgggtcgggatgggcgaggcggccgccatcttcatgaccgccacgccgcccgggtccgtggaggccttcccccagagcaacgcggtgatccaggacgaggagcgcgacatcccggagcggtcctggaacagcggctacgagtggatcacggacttccccggcaagaccgtctggttcgtgccctccatcaagagcgggaacgacatcgccaactgcctgcgcaagaacggcaagcgggtgatccagctgtcccgcaagaccttcgacaccgagtaccagaagacgaagaacaacgactgggactacgtcgtgaccaccgacatcagcgagatgggggccaacttccgggccgaccgcgtcatcgacccccggcgctgcctcaagccggtgatcctgaaggacggccccgagcgggtgatcctggcggggcccatgcccgtcaccgtggcctccgccgcccagcgccggggccgcatcggccgcaaccacaacaaggagggggaccagtacatctacatgggccagccgctcaacaacgacgaggaccacgcccactggacggaggcgaagatgctgctggacaacatcaacacccccgaggggatcatccccgccctcttcgagcccgagcgggagaagtccgccgccatcgacggcgagtaccgcctgcgcggggaggcccgcaagaccttcgtggagctgatgcggcgcggcgacctcccggtctggctgagctacaaggtggcgtccgagggcttccagtacagcgaccggcgctggtgcttcgacggggagcggaacaaccaggtgctggaggagaacatggacgtcgagatctggaccaaggagggcgagcgcaagaagctccggccccgctggctggacgcccggacgtactccgaccccctggccctccgcgagttcaaggagttcgccgccgggcggcgcagcgtgtccggcgacctgatcctggagatcggcaagctcccccagcacctgacccagcgggcgcagaacgccctggacaacctcgtgatgctgcacaacagcgagcagggcgggcgcgcctaccggcacgccatggaggagctgccggagaccatcgagaccctcatgctgctggcgctcatcgccgtcctgaccggcggggtgaccctgttcttcctctccgggcgcgggctgggcaagaccagcatcgggctgctctgcgtgatggcctccagcgccctgctgtggatggcctccgtcgagccccactggatcgcggccagcatcatcctcgagttcttcctgatggtgctgctcatccccgagcccgaccggcagcgcaccccgcaggacaaccagctggcctacgtggtcatcggcctcctcttcatgatcctgaccgtggccgccaacgagatggggctgctcgagacgaccaagaaggacctgggcatcgggcacgtggcggtcgagaaccaccaccacgccaccatgctggacgtggacctccaccccgcctccgcctggaccctgtacgccgtggcgacgaccatcatcacccccatgatgcgccacaccatcgagaacacgaccgccaacatcagcctgaccgccatcgccaaccaggccgcgatcctcatgggcctggacaagggctggccgatctccaagatggacatcggggtccccctgctcgccctgggctgctacagccaggtgaaccccctgaccctcacggccgccgtgctgatgctggtcgcgcactacgccatcatcgggcccggcctccaggccaaggccacccgggaggcccagaagcgcaccgcggccgggatcatgaagaacccgaccgtggacggcatcgtggccatcgacctggaccccgtcgtgtacgacgccaagttcgagaagcagctgggccagatcatgctcctgatcctgtgcacgtcccagatcctcctgatgcggaccacctgggccctgtgcgagagcatcaccctcgcgacggggcccctgaccaccctgtgggagggctcccccgggaagttctggaacaccacgatcgccgtgagcatggccaacatcttccgcggcagctacctcgccggcgccgggctggcgttctccctgatgaagtccctcggcgggggccggcgcgggaccggcgcccagggcgagaccctgggggagaagtggaagcggcagctgaaccagctctccaagagcgagttcaacacctacaagcgctccggcatcatggaggtcgaccggagcgaggccaaggaggggctgcgccggggcgagacgaccaagcacgccgtgtcccgcgggaccgcgaagctgcggtggttcgtggagcgcaacctggtcaagccggagggcaaggtgatcgacctcggctgcgggcggggcgggtggagctactactgcgccggcctgaagaaggtgaccgaggtcaaggggtacacgaagggcggccccgggcacgaggagcccatccccatggccacctacggctggaacctggtgaagctccactccgggaaggacgtgttcttcatcccgcccgagaagtgcgacaccctgctgtgcgacatcggcgagagctcccccaaccccaccatcgaggaggggcgcacgctccgggtcctgaagatggtggagccgtggctgcgcggcaaccagttctgcatcaagatcctcaacccctacatgcccagcgtggtcgagaccctggagcagatgcagcggaagcacggcgggatgctggtgcgcaaccccctctcccgcaacagcacccacgagatgtactgggtgtcctgcggcaccgggaacatcgtcagcgccgtgaacatgacctcccggatgctgctgaaccgcttcacgatggcccaccggaagccgacctacgagcgcgacgtggacctcggcgcgggcacccggcacgtcgccgtggagcccgaggtcgccaacctggacatcatcgggcagcgcatcgagaacatcaagcacgagcacaagagcacctggcactacgacgaggacaacccctacaagacgtgggcctaccacggctcctacgaggtgaagcccagcgggagcgcctccagcatggtgaacggcgtcgtgaagctgctcaccaagccgtgggacgtgatccccatggtcacccagatcgcgatgaccgacacgacccccttcgggcagcagcgggtgttcaaggagaaggtggacacccgcacccccaaggccaagcggggcacggcccagatcatggaggtcaccgcccgctggctgtggggcttcctgtcccggaacaagaagccgcgcatctgcacccgggaggagttcacccgcaaggtgcggagcaacgccgcgatcggggccgtgttcgtcgacgagaaccagtggaactccgccaaggaggccgtggaggacgagcgcttctgggacctcgtgcaccgggagcgcgagctgcacaagcagggcaagtgcgcgacgtgcgtctacaacatgatggggaagcgggagaagaagctgggcgagttcgggaaggccaagggcagccgcgccatctggtacatgtggctcggcgcccggttcctggagttcgaggccctggggttcatgaacgaggaccactggttctcccgcgagaacagcctctccggcgtggagggggagggcctgcacaagctggggtacatcctccgcgacatcagcaagatccccggcggcaacatgtacgcggacgacaccgccgggtgggacacccggatcaccgaggacgacctgcagaacgaggccaagatcacggacatcatggagcccgagcacgccctgctcgccacctccatcttcaagctgacctaccagaacaaggtggtccgcgtgcagcggccggcgaagaacggcaccgtgatggacgtcatcagccgccgggaccagcgcgggtccggccaggtgggcacgtacgggctgaacaccttcaccaacatggaggcccagctcatccggcagatggagagcgagggcatcttctcccccagcgagctggagacccccaacctggccgagcgcgtgctcgactggctggagaagtacggggtcgagcggctgaagcgcatggccatctccggcgacgactgcgtggtgaagcccatcgacgaccggttcgccacggcgctcaccgccctgaacgacatggggaaggtccgcaaggacatcccgcagtgggagcccagcaagggctggaacgactggcagcaggtccccttctgcagccaccacttccaccagctgatcatgaaggacggccgggagatcgtggtcccctgccgcaaccaggacgagctcgtggggcgggcccgcgtgtcccagggcgccgggtggagcctgcgggagaccgcctgcctgggcaagtcctacgcgcagatgtggcagctcatgtacttccaccgccgggacctgcgcctggccgccaacgccatctgcagcgcggtcccggtggactgggtgcccacctcccgcacgacctggagcatccacgcccaccaccagtggatgaccaccgaggacatgctctccgtctggaaccgggtgtggatcgaggagaacccctggatggaggacaagacgcacatcagctcctggggcgacgtgccctacctgggcaagcgcgaggaccagtggtgcggcagcctgatcgggctcaccgcccgggccacctgggccaccaacatccaggtcgcgatcaaccaggtgcgccggctgatcggcaacgagaactacctggactacatgacctccatgaagcgcttcaagaacgagagcgacccggagggggccctctggtga

SEQ ID NO: 8010 - RNA, 9879 nt, synthetic construct
  misc_feature 1..9879: note = derived and/or modified CDS sequence (opt1) from DENV-1__JN819423__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagctgtgcgaggacaccctcacctacaagtgcccccgcatcaccgaggtggagcccgacgacgtggactgctggtgcaacaccacggacacctgggtgacctacgggacctgcagccagacgggcgagcaccggcgcgacaagcggagcgtggccctggcgccccacgtgggcctggggctcgagacccgcgccgagacctggatgagcagcgagggcgcgtggaagcagatccagcgggtggagacctgggccctgcgccaccccgggttcacggtgatcgccctgttcctcgcccacgcgatcggcaccagcatcacccagaaggggatcatcttcatcctgctgatgctcgtcaccccctccatggccatgcggtgcgtgggcatcggcagccgcgacttcgtggaggggctgtccggcgccacgtgggtcgacgtggtgctggagcacgggagctgcgtcaccaccatggccaaggacaagcccaccctcgacatcgagctgctgaagacggaggtgaccaaccccgccgtgctccggaagctgtgcatcgaggcgaagatctccaacaccaccacggacagccgctgccccacccagggcgaggccaccctggtcgaggagcaggacgccaacttcgtgtgccggcgcaccttcgtggaccggggctgggggaacggctgcggcctgttcggcaaggggtccctgatcacgtgcgccaagttcaagtgcgtcaccaagctggagggcaagatcgtgcagtacgagaacctcaagtacagcgtgatcgtcaccgtgcacaccggcgaccagcaccaggtcgggaacgagtccacggagcacggcaccaccgccaccatcacgccccaggcgcccacgagcgagatccagctgaccgactacggggccctgaccctcgactgcagcccccggaccggcctggacttcaacgagatggtgctgctcacgatgaaggagaagtcctggctggtgcacaagcagtggttcctggacctcccgctgccctggaccagcggggcctccaccagccaggagacctggaaccggcaggacctgctcgtcacgttcaagaccgcccacgccaagaagcaggaggtggtggtcctgggctcccaggagggcgcgatgcacaccgccctgaccggggccacggagatccagaccagcggcaccaccacgatcttcgccgggcacctcaagtgccgcctgaagatggacaagctgaccctcaagggcatgtcctacgtgatgtgcaccgggagcttcaagctggagaaggaggtggccgagacccagcacggcacggtcctggtgcagatcaagtacgagggcaccgacgcgccctgcaagatccccttctccacccaggacgggaagggcgtgacccagaacgggcggctgatcacggccaacccgatcgtcaccgacaaggagaagcccgtgaacatcgaggccgagccgcccttcggcgagagctacatcgtgatcggcgccggggagaaggcgctcaagctgtcctggttcaagaagggcagctccatcgggaagatgttcgaggccaccgcccgcggcgcccggcgcatggccatcctgggggacaccgcgtgggacttcggcagcgtcggcggggtgttcacgtccgtgggcaagctcgtccaccagatcttcgggaccgcctacggcgtgctgttcagcggggtgtcctggaccatgaagatcggcatcggcgtcctgctcacctggctggggctgaacagccgctccacgagcctctccatgacctgcatcgccgtgggcctggtgaccctgtacctcggggtcatggtgcaggccgacagcggctgcgtgatcaactggaaggggcgggagctgaagtgcggcagcggcatcttcgtcaccaacgaggtgcacacgtggaccgagcagtacaagttccaggccgactccccgaagcgcctgagcgcggccatcgggaaggcctgggaggagggcgtgtgcgggatccggtccgccacccgcctcgagaacgtcatgtggcggcagatcagcaacgagctgaaccacatcctgctcgagaacgacatgaagttcaccgtggtggtcggcgacgtggtggggatcctggcccagggcaagaagatgatccgcccccagcccatggagcacaagtactcctggaagtcctggggcaaggcgaagatcatcggggccgacgtccagaacaccacgttcatcatcgacggccccaacacctccgagtgcccggacgaccagcgggcctggaacatctgggaggtggaggactacgggttcggcatcttcaccaccaacatctggctgaagctccgcgacagctacacccaggtgtgcgaccaccggctgatgtccgccgcgatcaaggacagccgcgccgtccacgccgacatgggctactggatcgagtccgagaagaacgagacctggaagctggcccgggccagcttcatcgaggtgaagacctgcatctggcccaagtcccacaccctctggagcaacggggtgctggagtccgagatgatcatccccaagatctacggcgggcccatcagccagcacaactaccgcccgggctacttcacgcagaccgcggggccctggcacctgggcaagctcgagctggacttcgacctgtgcgagggcaccaccgtcgtggtggacgagcactgcgggaaccggggcccctccctccgcacgaccaccgtcaccgggaagatcatccacgagtggtgctgccggagctgcacgctgccgcccctgcgcttcaagggcgaggacgggtgctggtacggcatggagatccggcccgtgaaggagaaggaggagaacctcgtcaagagcatggtctccgccggcagcggggaggtggactccttcagcctgggcctgctctgcatctccatcatgatcgaggaggtgatgcgcagccggtggtcccgcaagatgctgatgaccgggaccctggccgtcttcttcctcctgatcatgggccagctgacctggaacgacctcatccgcctgtgcatcatggtgggggccaacgccagcgaccggatgggcatgggcacgacgtacctggcgctcatggccaccttcaagatgcgccccatgttcgccgtcgggctgctgttccggcgcctcacctcccgggaggtgctgctgctcacgatcgggctgagcctggtggcctccgtcgagctcccgaacagcctggaggagctgggggacggcctcgccatgggcatcatgatcctgaagctgctcaccgacttccagtcctaccagctgtgggcgaccctgctcagcctgaccttcatcaagacgaccttctccctgcactacgcctggaagaccatggccatggtgctcagcatcgtgtccctgctgcccctctgcctgagcaccacgtcccagaagaccacctggctgcccgtcctcctggggagcctgggctgcaagcccctcaccatgttcctgatcgccgagaacaagatctgggggcgcaagagctggccgctgaacgagggcatcatggcggtggggatcgtgtccatcctcctgagctccctgctcaagaacgacgtccccctggccggccccctgatcgccggcgggatgctcatcgcctgctacgtgatcagcggctccagcgccgacctgtccctggagaaggcggccgaggtgagctgggaggaggaggccgagcactccggggccagccacaacatcctcgtcgaggtgcaggacgacggcacgatgaagatcaaggacgaggagcgggacgacaccctgaccatcctgctcaaggccaccctgctggcggtgtccggggtctaccccctcagcatcccggccaccctgttcgtgtggtacttctggcagaagaagaagcagcgctccggcgtgctgtgggacacgccctccccgcccgaggtcgagcgggccgtgctggacgacggcatctaccgcatcatgcagcgggggctcctgggccgctcccaggtgggggtcggcgtgttccaggagaacgtgttccacaccatgtggcacgtcacccgcggggccgtgctgatgtaccagggcaagcgcctcgagccgagctgggcctccgtgaagaaggacctgatcagctacggcgggggctggcggctgcaggggtcctggaacaccggcgaggaggtccaggtgatcgcggtggagcccgggaagaaccccaagaacgtccagacggcccccggcaccttcaagaccccggagggcgaggtgggggccatcgccctcgacttcaagcccggcaccagcgggagccccatcgtgaaccgcgagggcaagatcgtcggcctgtacgggaacggcgtggtgacgacctccgggacctacgtcagcgccatcgcgcaggccaaggcctcccaggagggccccctgccggagatcgaggacgaggtgttccggaagcgcaacctcaccatcatggacctgcaccccgggagcggcaagacgcggcgctacctgcccgccatcgtgcgggaggcgatcaagcgcaagctccgcaccctgatcctggccccgacccgggtcgtggcctccgagatggccgaggccctcaagggcatgcccatccgctaccagaccacggcggtcaagagcgagcacaccgggcgggagatcgtcgacctgatgtgccacgccaccttcaccatgcgcctgctctcccccgtgcgggtgcccaactacaacatgatcatcatggacgaggcccacttcacggacccgagctccatcgccgcccgcggctacatcagcacccgggtcgggatgggcgaggcggccgccatcttcatgaccgccacgccgcccgggtccgtggaggccttcccccagagcaacgcggtgatccaggacgaggagcgcgacatcccggagcggtcctggaacagcggctacgagtggatcacggacttccccggcaagaccgtctggttcgtgccctccatcaagagcgggaacgacatcgccaactgcctgcgcaagaacggcaagcgggtgatccagctgtcccgcaagaccttcgacaccgagtaccagaagacgaagaacaacgactgggactacgtcgtgaccaccgacatcagcgagatgggggccaacttccgggccgaccgcgtcatcgacccccggcgctgcctcaagccggtgatcctgaaggacggccccgagcgggtgatcctggcggggcccatgcccgtcaccgtggcctccgccgcccagcgccggggccgcatcggccgcaaccacaacaaggagggggaccagtacatctacatgggccagccgctcaacaacgacgaggaccacgcccactggacggaggcgaagatgctgctggacaacatcaacacccccgaggggatcatccccgccctcttcgagcccgagcgggagaagtccgccgccatcgacggcgagtaccgcctgcgcggggaggcccgcaagaccttcgtggagctgatgcggcgcggcgacctcccggtctggctgagctacaaggtggcgtccgagggcttccagtacagcgaccggcgctggtgcttcgacggggagcggaacaaccaggtgctggaggagaacatggacgtcgagatctggaccaaggagggcgagcgcaagaagctccggccccgctggctggacgcccggacgtactccgaccccctggccctccgcgagttcaaggagttcgccgccgggcggcgcagcgtgtccggcgacctgatcctggagatcggcaagctcccccagcacctgacccagcgggcgcagaacgccctggacaacctcgtgatgctgcacaacagcgagcagggcgggcgcgcctaccggcacgccatggaggagctgccggagaccatcgagaccctcatgctgctggcgctcatcgccgtcctgaccggcggggtgaccctgttcttcctctccgggcgcgggctgggcaagaccagcatcgggctgctctgcgtgatggcctccagcgccctgctgtggatggcctccgtcgagccccactggatcgcggccagcatcatcctcgagttcttcctgatggtgctgctcatccccgagcccgaccggcagcgcaccccgcaggacaaccagctggcctacgtggtcatcggcctcctcttcatgatcctgaccgtggccgccaacgagatggggctgctcgagacgaccaagaaggacctgggcatcgggcacgtggcggtcgagaaccaccaccacgccaccatgctggacgtggacctccaccccgcctccgcctggaccctgtacgccgtggcgacgaccatcatcacccccatgatgcgccacaccatcgagaacacgaccgccaacatcagcctgaccgccatcgccaaccaggccgcgatcctcatgggcctggacaagggctggccgatctccaagatggacatcggggtccccctgctcgccctgggctgctacagccaggtgaaccccctgaccctcacggccgccgtgctgatgctggtcgcgcactacgccatcatcgggcccggcctccaggccaaggccacccgggaggcccagaagcgcaccgcggccgggatcatgaagaacccgaccgtggacggcatcgtggccatcgacctggaccccgtcgtgtacgacgccaagttcgagaagcagctgggccagatcatgctcctgatcctgtgcacgtcccagatcctcctgatgcggaccacctgggccctgtgcgagagcatcaccctcgcgacggggcccctgaccaccctgtgggagggctcccccgggaagttctggaacaccacgatcgccgtgagcatggccaacatcttccgcggcagctacctcgccggcgccgggctggcgttctccctgatgaagtccctcggcgggggccggcgcgggaccggcgcccagggcgagaccctgggggagaagtggaagcggcagctgaaccagctctccaagagcgagttcaacacctacaagcgctccggcatcatggaggtcgaccggagcgaggccaaggaggggctgcgccggggcgagacgaccaagcacgccgtgtcccgcgggaccgcgaagctgcggtggttcgtggagcgcaacctggtcaagccggagggcaaggtgatcgacctcggctgcgggcggggcgggtggagctactactgcgccggcctgaagaaggtgaccgaggtcaaggggtacacgaagggcggccccgggcacgaggagcccatccccatggccacctacggctggaacctggtgaagctccactccgggaaggacgtgttcttcatcccgcccgagaagtgcgacaccctgctgtgcgacatcggcgagagctcccccaaccccaccatcgaggaggggcgcacgctccgggtcctgaagatggtggagccgtggctgcgcggcaaccagttctgcatcaagatcctcaacccctacatgcccagcgtggtcgagaccctggagcagatgcagcggaagcacggcgggatgctggtgcgcaaccccctctcccgcaacagcacccacgagatgtactgggtgtcctgcggcaccgggaacatcgtcagcgccgtgaacatgacctcccggatgctgctgaaccgcttcacgatggcccaccggaagccgacctacgagcgcgacgtggacctcggcgcgggcacccggcacgtcgccgtggagcccgaggtcgccaacctggacatcatcgggcagcgcatcgagaacatcaagcacgagcacaagagcacctggcactacgacgaggacaacccctacaagacgtgggcctaccacggctcctacgaggtgaagcccagcgggagcgcctccagcatggtgaacggcgtcgtgaagctgctcaccaagccgtgggacgtgatccccatggtcacccagatcgcgatgaccgacacgacccccttcgggcagcagcgggtgttcaaggagaaggtggacacccgcacccccaaggccaagcggggcacggcccagatcatggaggtcaccgcccgctggctgtggggcttcctgtcccggaacaagaagccgcgcatctgcacccgggaggagttcacccgcaaggtgcggagcaacgccgcgatcggggccgtgttcgtcgacgagaaccagtggaactccgccaaggaggccgtggaggacgagcgcttctgggacctcgtgcaccgggagcgcgagctgcacaagcagggcaagtgcgcgacgtgcgtctacaacatgatggggaagcgggagaagaagctgggcgagttcgggaaggccaagggcagccgcgccatctggtacatgtggctcggcgcccggttcctggagttcgaggccctggggttcatgaacgaggaccactggttctcccgcgagaacagcctctccggcgtggagggggagggcctgcacaagctggggtacatcctccgcgacatcagcaagatccccggcggcaacatgtacgcggacgacaccgccgggtgggacacccggatcaccgaggacgacctgcagaacgaggccaagatcacggacatcatggagcccgagcacgccctgctcgccacctccatcttcaagctgacctaccagaacaaggtggtccgcgtgcagcggccggcgaagaacggcaccgtgatggacgtcatcagccgccgggaccagcgcgggtccggccaggtgggcacgtacgggctgaacaccttcaccaacatggaggcccagctcatccggcagatggagagcgagggcatcttctcccccagcgagctggagacccccaacctggccgagcgcgtgctcgactggctggagaagtacggggtcgagcggctgaagcgcatggccatctccggcgacgactgcgtggtgaagcccatcgacgaccggttcgccacggcgctcaccgccctgaacgacatggggaaggtccgcaaggacatcccgcagtgggagcccagcaagggctggaacgactggcagcaggtccccttctgcagccaccacttccaccagctgatcatgaaggacggccgggagatcgtggtcccctgccgcaaccaggacgagctcgtggggcgggcccgcgtgtcccagggcgccgggtggagcctgcgggagaccgcctgcctgggcaagtcctacgcgcagatgtggcagctcatgtacttccaccgccgggacctgcgcctggccgccaacgccatctgcagcgcggtcccggtggactgggtgcccacctcccgcacgacctggagcatccacgcccaccagcagtggatgaccaccgaggacatgctctccgtctggaaccgggtgtggatcgaggagaacccctggatggaggacaagacgcacatcagctcctggggcgacgtgccctacctgggcaagcgcgaggaccagtggtgcggcagcctgatcgggctcaccgcccgggccacctgggccaccaacatccaggtcgcgatcaaccaggtgcgccggctgatcggcaacgagaactacctggactacatgacctccatgaagcgcttcaagaacgagagcgacccggagggggccctctggtga

SEQ ID NO: 8011 - RNA, 9879 nt, synthetic construct
  misc_feature 1..9879: note = derived and/or modified CDS sequence (opt1) from DENV-1__FJ639672__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcagctcccgcgacttcgtggagggcctcagcggggccacgtgggtggacgtcgtgctggagcacggctcctgcgtgaccaccatggccaaggacaagcccaccctggacatcgagctcctgaagacggaggtcaccaaccccgcggtgctgcggaagctctgcatcgaggccaagatcagcaacaccaccacggactcccgctgcccgacccagggggaggccaccctggtggaggagcaggacgccaacttcgtctgccggcgcaccttcgtggaccggggctggggcaacgggtgcggcctgttcgggaagggcagcctcatcacgtgcgccaagttcaagtgcgtgaccaagctggaggggaagatcgtccagtacgagaacctgaagtactccgtgatcgtgaccgtccacaccggcgaccagcaccaggtgggcaacgagagcacggagcacgggaccaccgcgaccatcacgccccaggcccccacgaccgagatccagctcaccgactacggcgccctgaccctggactgcagcccccggacggggctcgacttcaacgagatggtcctgctgaccatgaaggagaagtcctggctcgtgcacaagcagtggttcctggacctgcccctcccctggaccagcggcgcctccaccagccaggagacgtggaaccggcaggacctgctggtgaccttcaagaccgcccacgcgaagaagcaggaggtcgtggtgctcgggtcccaggagggcgccatgcacaccgccctgacgggcgccaccgagatccagaccagcgggaccacgaccatcttcgccggccacctgaagtgccgcctcaagatggacaagctgaccctgaaggggatgtcctacgtcatgtgcaccggcagcttcaagctcgagaaggaggtggcggagacgcagcacgggaccgtgctggtccagatcaagtacgagggcaccgacgccccctgcaagatccccttctccacccaggacgagaagggcgtgacgcagaacgggcggctgatcaccgccaacccgatcgtgaccgacaaggagaagcccgtcaacatcgaggccgagccgcccttcggcgagagctacatcgtgatcggggcgggcgagaaggccctgaagctctcctggttcaagaagggcagctccatcgggaagatgttcgaggccaccgcccgcggcgcccggcgcatggcgatcctgggggacacggcctgggacttcggcagcatcgggggcgtgttcacctccgtcggcaagctggtgcaccagatcttcgggaccgcctacggcgtcctcttcagcggggtctcctggaccatgaagatcggcatcggggtgctgctgacgtggctcggcctgaacagccgctccaccagcctgtccatgacctgcatcgccgtgggcctcgtcaccctgtacctgggggtgatggtgcaggccgacagcggctgcgtcatcaactggaaggggcgggagctcaagtgcggcagcgggatcttcgtgacgaacgaggtgcacacctggaccgagcagtacaagttccaggcggactccccgaagcgcctgagcgccgccatcggcaaggcctgggaggagggcgtctgcgggatccggtccgccacccgcctggagaacatcatgtggaagcagatcagcaacgagctcaaccacatcctgctggagaacgacatgaagctcaccgtggtggtcggcgacgtggcggggatcctggcccagggcaagaagatgatccggccccagcccatggagtacaagtactcctggaagtcctgggggaaggccaagatcatcggcgccgacgtgcagaacacgaccttcatcatcgacggccccaacaccccggagtgccccgacgaccagcgcgcgtggaacatctgggaggtcgaggactacgggttcggcatcttcaccacgaacatctggctgaagctccgggactcctacacccaggtgtgcgaccaccgcctgatgagcgccgccatcaaggactccaaggccgtgcacgccgacatggggtactggatcgagagcgagaagaacgagacctggaagctggcgcgggcctccttcatcgaggtcaagacctgcatctggcccaagagccacacgctctggtccaacggcgtgctggagagcgagatgatcatccccaagatctacggcgggccgatctcccagcacaactaccgccccggctacttcacccagaccgccgggccctggcacctgggcaagctcgagctggacttcgacctgtgcgaggggaccacggtggtcgtggacgagcactgcggcaaccggggcccgagcctccgcaccaccaccgtgacggggaagatcatccacgagtggtgctgccggtcctgcaccctgccgcccctgcgcttccggggcgaggacgggtgctggtacggcatggagatccgccccgtcaaggagaaggaggagaacctcgtcaagagcatggtgagcgccgggtccggcgaggtcgacagcttctccctgggcctgctctgcatcagcatcatgatcgaggaggtgatgcggtcccgctggagccggaagatgctgatgaccgggaccctggccgtgttcttcctcctgatcatgggccagctgacgtggaacgacctcatccgcctgtgcatcatggtcggggcgaacgcctccgaccgcatgggcatggggaccacctacctggccctcatggccaccttcaagatgcggccgatgttcgccgtgggcctgctgttccgccggctcacgagccgcgaggtgctgctgctcaccatcggcctgtccctggtcgcgagcgtggagctccccaactccctggaggagctgggggacggcctcgccatggggatcatgatcctgaagctgctcaccgacttccagagccaccagctgtgggccaccctgctctccctgacgttcatcaagaccaccttcagcctgcactacgcctggaagaccatggcgatggtcctctccatcgtgagcctgttccccctgtgcctctccacgaccagccagaagaccacctggctgcccgtgctgctcggctccctgggctgcaagccgctgacgatgttcctcatcgccgagaacaagatctgggggcgcaagagctggcccctgaacgagggcatcatggccgtcgggatcgtgagcatcctgctctccagcctgctgaagaacgacgtgcccctcgccggccccctgatcgccgggggcatgctgatcgcgtgctacgtcatctccggcagctccgccgacctcagcctggagaaggccgccgaggtgtcctgggaggaggaggccgagcacagcggggcgtcccacaacatcctggtggaggtccaggacgacggcaccatgaagatcaaggacgaggagcgcgacgacaccctcaccatcctgctgaaggccaccctcctggccgtgagcggggtgtacccgctgtccatccccgccaccctcttcgtctggtacttctggcagaagaagaagcagcggagcggcgtgctgtgggacacccccagcccgcccgaggtggagcgcgccgtcctggacgacgggatctaccggatcatgcagcgcggcctgctcggccggagccaggtgggggtgggcgtcttccaggagaacgtgttccacaccatgtggcacgtgacccgcggggcggtcctgatgtaccagggcaagcggctggagccctcctgggccagcgtgaagaaggacctcatctcctacgggggcggctggcgcctgcaggggagctggaacacgggcgaggaggtgcaggtcatcgccgtggagcccgggaagaaccccaagaacgtgcagaccgcccccggcaccttcaagacccccgagggggaggtcggcgccatcgcgctggacttcaagcccggcacgtccgggagccccatcgtgaaccgggagggcaagatcgtggggctctacggcaacggcgtcgtgaccaccagcgggacctacgtgtccgccatcgcccaggccaaggcgagccaggagggcccgctgcccgagatcgaggacgaggtcttccgcaagcggaacctgacgatcatggacctccaccccgggtccggcaagacccgccggtacctgccggccatcgtgcgcgaggccatcaagcggaagctgcgcaccctcatcctggcccccacccgcgtggtcgccagcgagatggcggaggccctgaaggggatgcccatccggtaccagacgaccgccgtgaagtccgagcacaccggcaaggagatcgtggacctcatgtgccacgccaccttcacgatgcgcctgctgagccccgtccgggtgccgaactacaacatgatcatcatggacgaggcccacttcaccgacccctccagcatcgcggcccgcggctacatctccacccgggtggggatgggcgaggccgccgccatcttcatgaccgcgacgccgcccgggagcgtcgaggccttcccgcagtccaacgccgtgatccaggacgaggagcgcgacatccccgagcggagctggaactccggctacgagtggatcaccgacttccccgggaagaccgtgtggttcgtccccagcatcaagtccggcaacgacatcgccaactgcctccgcaagaacggcaagcgggtgatccagctgagccgcaagaccttcgacacggagtaccagaagaccaagaacaacgactgggactacgtggtcaccaccgacatctccgagatgggggcgaacttccgggccgaccgcgtgatcgacccgcggcgctgcctgaagcccgtgatcctcaaggacggccccgagcgggtcatcctggccgggcccatgccggtgacggtcgccagcgccgcgcagcgccggggccgcatcgggcggaaccacaacaaggagggcgaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcgatcgacggcgagtaccgcctccgcggggaggcccgcaagaccttcgtggagctgatgcggcgcggcgacctgcccgtgtggctcagctacaaggtcgccagcgaggggttccagtactccgaccggcgctggtgcttcgacggcgagcggaacaaccaggtgctggaggagaacatggacgtggagatctggacgaaggagggcgagcgcaagaagctgcggccccgctggctcgacgcccggacctacagcgaccccctggccctgcgcgagttcaaggagttcgcggccgggcggcgctccgtcagcggcgacctcatcctggagatcgggaagctgccgcagcacctcacccagcgggcccagaacgccctggacaacctggtgatgctccacaactccgagcagggcggccgcgcgtaccggcacgccatggaggagctgcccgacaccatcgagacgctgatgctcctggccctgatcgccgtgctcaccgggggcgtcaccctgttcttcctgagcgggcgcggcctcgggaagacctccatcggcctgctgtgcgtgatggccagctccgtgctcctgtggatggcgagcgtcgagccccactggatcgccgcctccatcatcctggagttcttcctcatggtgctgctgatccccgagccggaccggcagcgcacgccccaggacaaccagctcgcctacgtggtcatcggcctgctgttcatgatcctcacggtggccgcgaacgagatggggctgctggagaccaccaagaaggacctcggcatcgggcacgtggccgtcgagaaccaccaccacgccgccatgctggacgtggacctgcaccccgccagcgcgtggaccctctacgccgtggccacgaccatcatcaccccgatgatgcggcacaccatcgagaacacgaccgccaacatctccctgaccgccatcgcgaaccaggccgccatcctgatgggcctcgacaaggggtggcccatcagcaagatggacatcggcgtccccctgctggccctcggctgctactcccaggtgaaccccctgaccctgacggcggccgtgctcatgctggtcgcccactacgccatcatcgggccgggcctgcaggccaaggcgacccgcgaggcccagaagcgcaccgccgccgggatcatgaagaaccccaccgtggacggcatcgtggccatcgacctcgaccccgtcgtgtacgacgcgaagttcgagaagcagctggggcagatcatgctgctcatcctgtgcacgagccagatcctgctcatgcggaccacctgggccctgtgcgagtccatcaccctggccacgggccccctcaccaccctgtgggagggcagcccggggaagttctggaacaccacgatcgccgtgtccatggccaacatcttccgcggcagctacctggcgggggccggcctcgccttcagcctgatgaagtccctgggcgggggccggcgcgggaccggcgcccagggggagaccctcggcgagaagtggaagcggcagctgaaccagctgagcaagtccgagttcaacacctacaagcgcagcggcatcatggaggtcgaccggtccgaggcgaaggaggggctcaagcgcggcgagacgaccaagcacgccgtgagccgggggaccgccaagctgcgctggttcgtggagcggaacctggtcaagcccgagggcaaggtgatcgacctggggtgcggccgcggcgggtggtcctactactgcgccggcctcaagaaggtgaccgaggtcaaggggtacacgaagggcgggcccggccacgaggagcccatcccgatggccacctacggctggaacctggtgaagctgcacagcgggaaggacgcgttcttcatcccgcccgagaagtgcgacaccctcctgtgcgacatcggcgagtccagccccaacccgaccatcgaggaggggcggacgctgcgcgtgctcaagatggtcgagccctggctgcggggcaaccagttctgcatcaagatcctgaacccctacatgccctccgtggtggagaccctcgagcagatgcagcgcaagcacgggggcatgctggtccggaacccgctgagccgcaactccacccacgagatgtactgggtgagctgcggcaccgggaacatcgtgtccgccgtcaacatgaccagccggatgctcctgaaccgcttcacgatggcccaccgcaagcccacctacgagcgggacgtggacctgggcaccgggacccgccacgtggccgtcgagcccgaggtggccaacctcgacatcatcggccagcggatcgagaacatcaagcacgagcacaagtccacgtggcactacgacgaggacaacccctacaagacctgggcgtaccacggcagctacgaggtgaagccgtccgggagcgccagctccatggtcaacggcgtggtcaagctgctgaccaagccctgggacgtgatccccatggtgacccagatcgccatgacggacaccacccccttcgggcagcagcgcgtcttcaaggagaaggtggacacccggacgccgaaggccaagcgcggcaccgcccagatcatggaggtgaccgcgcggtggctctgggggttcctgagccgcaacaagaagccccggatctgcacccgcgaggagttcacgcggaaggtccgctccaacgccgccatcggcgccgtgttcgtggacgagaaccagtggaacagcgcgaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggctcccgggccatctggtacatgtggctgggggcgcgcttcctcgagttcgaggccctgggcttcatgaacgaggaccactggttcagccgggagaactccctgagcggcgtcgagggggagggcctccacaagctggggtacatcctgcgcgacatctccaagatccccggcgggaacatgtacgccgacgacaccgccggctgggacacccggatcacggaggacgacctccagaacgaggccaagatcaccgacatcatggagccggagcacgcgctgctggccaaggccatcttcaagctcacctaccagaacaaggtggtgcgcgtccagcgccccgccaagaacggcaccgtgatggacgtgatcagccggcgcgaccagcgggggtccggccaggtcgggacgtacggcctgaacaccttcaccaacatggaggcccagctgatccgccagatggagagcgagggcatcttctcccccagcgagctcgagacccccaacctggcggagcgggccctggactggctcgagaagtacggggtggagcgcctgaagcggatggccatctccggcgacgactgcgtggtcaagccgatcgacgaccgcttcgccacggccctgaccgcgctcaacgacatggggaaggtgcggaaggacatcccccagtgggagcccagcaagggctggaacgactggcagcaggtccccttctgctcccaccacttccaccagctgatcatgaaggacgggcgcgagatcgtcgtgccgtgccggaaccaggacgagctggtgggccgcgcccgggtcagccagggcgccgggtggagcctccgcgagaccgcctgcctgggcaagtcctacgcgcagatgtggcagctgatgtacttccaccggcgcgacctccggctggccgccaacgccatctgcagcgccgtgcccgtggactgggtccccacctcccgcacgacctggagcatccacgcgcaccaccagtggatgaccaccgaggacatgctgtccgtgtggaaccgggtgtggatcgaggagaacccctggatggaggacaagacgcacatcagctcctgggaggacgtcccgtacctcgggaagcgcgaggaccagtggtgcggcagcctgatcgggctgaccgcccgcgccacctgggccaccaacatccaggtggccatcaaccaggtgcggcgcctcatcggcaacgagaactacctggactacatgacctccatgaagcggttcaagaacgagagcgaccccgagggcgcgctgtggtga

SEQ ID NO: 8012 - RNA, 9879 nt, synthetic construct
  misc_feature 1..9879: note = derived and/or modified CDS sequence (opt1) from DENV-1__FJ639673__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggtggagcccgacgacgtcgactgctggtgcaacaccaccgacacctgggtgacctacgggacctgcagccagacgggcgagcaccggcgcgacaagcggagcgtggccctcgcgccccacgtcggcctggggctggagacccgcgccgagacctggatgagctccgagggcgcgtggaagcagatccagcgggtggagacctgggccctccgccaccccgggttcacggtgatcgccctgttcctggcccacgcgatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcggaagctctgcatcgaggcgaagatctccaacaccaccacggacagccgctgcccgacccagggcgaggccaccctggtcgaggagcaggacgccaacttcgtgtgccggcgcaccttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccggcaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccgcctcaagatggacaagctgaccctgaagggcatgtcctacgtgatgtgcaccgggagcttcaagctcgagaaggaggtggccgagacccagcacggcacggtcctggtgcagatcaagtacgagggcaccgacgcgccctgcaagatccccttctccacccaggacgagaagggggtgacccagaacggccggctgatcacggccaacccgatcgtcaccgacaaggagaagcccgtgaacatcgaggccgagccgcccttcggggagagctacatcgtgatcggcgccggcgagaaggcgctgaagctctcctggttcaagaaggggagctccatcggcaagatgttcgaggccaccgcccgcggggcccggcgcatggccatcctgggcgacaccgcgtgggacttcgggagcatcggcggcgtcttcacgtccgtggggaagctggtgcaccagatcttcggcaccgcctacggggtcctcttcagcggcgtgtcctggaccatgaagatcgggatcggcgtgctgctgacctggctcggcctgaacagccgctccacgagcctgtccatgacctgcatcgccgtcgggctcgtgaccctgtacctgggcgtgatggtccaggccgacagcgggtgcgtgatcaactggaagggccgggagctcaagtgcgggagcggcatcttcgtgaccaacgaggtccacacgtggaccgagcagtacaagttccaggccgactccccgaagcgcctgagcgcggccatcggcaaggcctgggaggagggggtgtgcggcatccggtccgccacccgcctggagaacatcatgtggcggcagatcagcaacgagctcaaccacatcctgctggagaacgacatgaagttcaccgtggtcgtgggggacgtggtcggcatcctcgcccaggggaagaagatgatccgcccccagcccatggagcacaagtactcctggaagtcctggggcaaggcgaagatcatcggcgccgacgtgcagaacaccacgttcatcatcgacgggcccaacaccccggagtgccccgacgaccagcgggcctggaacatctgggaggtggaggactacggcttcgggatcttcaccaccaacatctggctgaagctgcgcgactcctacacgcaggtctgcgaccaccggctcatgagcgccgcgatcaaggactccaaggccgtgcacgccgacatgggctactggatcgagagcgagaagaacgagacctggaagctggcccgcgcctccttcatcgaggtgaagacctgcatctggcccaagagccacaccctgtggtccaacggcgtcctcgagagcgagatgatcatccccaagatctacgggggcccgatctcccagcacaactaccggcccgggtacttcacgcagaccgcgggcccctggcacctggggaagctggagctcgacttcgacctgtgcgagggcaccaccgtggtggtcgacgagcactgcggcaaccgcgggccgagcctgcggacgaccaccgtgaccggcaagatcatccacgagtggtgctgccgctcctgcacgctgccgcccctccggttcaagggggaggacggctgctggtacgggatggagatccgccccgtgaaggagaaggaggagaacctggtcaagagcatggtgagcgccggctccggcgaggtggacagcttctccctcgggctgctgtgcatcagcatcatgatcgaggaggtcatgcggtcccgctggagccggaagatgctcatgaccggcaccctggccgtgttcttcctgctcatcatggggcagctgacctggaacgacctgatccgctcctgcatcatggtgggcgccaacgccagcgaccgcatggggatgggcacgacctacctcgcgctgatggccaccttcaagatgcggccgatgttcgccgtcggcctgctgttccgccggctgacctcccgcgaggtgctgctcctgacgatcgggctgagcctcgtcgcctccgtggagctgcccaacagcctggaggagctcggcgacgggctggccatgggcatcatgatcctgaagctcctgaccgacttccagtcctaccagctgtgggcgaccctcctgagcctgaccttcatcaagacgaccttctccctccactacgcctggaagaccatggccatggtgctgagcatcgtctccctgctccccctgtgcctgagcaccacgtcccagaagaccacctggctccccgtgctgctgggcagcctcgggtgcaagccgctgaccatgttcctgatcgccgagaacaagatctggggccgcaagagctggcccctcaacgaggggatcatggcggtgggcatcgtctccatcctgctgagctccctcctgaagaacgacgtgcccctggccgggcccctcatcgccggcggcatgctgatcgcctgctacgtgatcagcgggtccagcgccgacctgtccctcgagaaggcggccgtcgtgagctgggaggaggaggccgagcactccggcgccagccacaacatcctggtggaggtccaggacgacgggacgatgaagatcaaggacgaggagcgcgacgacaccctgaccatcctcctgaaggccaccctgctcgcggtgtccggcgtgtacccgctgagcatccccgccaccctgttcgtctggtacttctggcagaagaagaagcagcggtccggggtgctctgggacacgcccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgccgtcctcatgtaccaggggaagcggctggagcccagctgggcctccgtgaagaaggacctgatcagctacggcggcgggtggcgcctccagggctcctggaacaccggggaggaggtgcaggtcatcgcggtggagcccggcaagaaccccaagaacgtgcagacggcccccgggaccttcaagacccccgagggcgaggtcggcgccatcgccctggacttcaagcccgggaccagcggcagccccatcgtgaaccgggaggggaagatcgtgggcctgtacggcaacggggtcgtgacgacctccggcacctacgtgagcgccatcgcgcaggccaaggcctcccaggaggggccgctccccgagatcgaggacgaggtcttccgcaagcggaacctgaccatcatggacctgcaccccggcagcgggaagacgcgccggtacctcccggccatcgtgcgcgaggcgatcaagcggaagctgcgcaccctgatcctcgcccccacccgcgtggtcgcctccgagatggccgaggccctgaagggcatgcccatccggtaccagaccacggcggtcaagagcgagcacaccggccgcgagatcgtggacctgatgtgccacgccaccttcaccatgcggctcctgtcccccgtccgcgtgccgaactacaacatgatcatcatggacgaggcccacttcacggaccccagctccatcgccgcccgggggtacatcagcacccgcgtgggcatgggggaggcggccgccatcttcatgaccgccacgccgcccggctccgtcgaggccttcccgcagagcaacgcggtgatccaggacgaggagcgggacatccccgagcgctcctggaacagcgggtacgagtggatcacggacttccccggcaagaccgtgtggttcgtcccctccatcaagagcggcaacgacatcgccaactgcctgcggaagaacgggaagcgcgtgatccagctctcccggaagaccttcgacaccgagtaccagaagacgaagaacaacgactgggactacgtggtcaccaccgacatcagcgagatgggcgccaacttccgcgccgaccgggtgatcgacccgcgccggtgcctgaagcccgtcatcctgaaggacgggcccgagcgcgtgatcctcgcgggccccatgccggtgaccgtcgcctccgccgcccagcggcgcgggcggatcggccgcaaccacaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccggctgcgcggcgaggcccggaagaccttcgtggagctcatgcgccgcggggacctgcccgtgtggctgagctacaaggtcgcgtccgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacgtactccgaccccctcgccctgcgggagttcaaggagttcgccgccggccgccggagcgtctccggggacctgatcctcgagatcggcaagctgccgcagcacctgacccagcgcgcgcagaacgccctcgacaacctggtgatgctgcacaacagcgagcagggcgggcgggcctaccgccacgccatggaggagctccccgacaccatcgagaccctgatgctgctcgcgctgatcgccgtgctgacgggcggggtcaccctcttcttcctgtccggccgggggctgggcaagaccagcatcggcctcctgtgcgtgatggcctccagcgccctgctctggatggcctccgtggagccccactggatcgcggccagcatcatcctggagttcttcctgatggtcctcctgatccccgagccggaccgccagcggacgccccaggacaaccagctggcctacgtggtgatcgggctcctgttcatgatcctgaccgtcgccgccaacgagatgggcctcctggagacgaccaagaaggacctggggatcggccacgtggcggtggagaaccaccaccacgccaccatgctcgacgtcgacctgcaccccgcctccgcctggaccctgtacgccgtggcgacgaccatcatcaccccgatgatgcgccacaccatcgagaacacgaccgccaacatcagcctcaccgccatcgccaaccaggccgcgatcctgatggggctggacaagggctggcccatctccaagatggacatcggcgtgcccctcctggccctggggtgctacagccaggtcaaccccctcaccctgacggccgccgtgctgatgctcgtggcgcactacgccatcatcggcccggggctgcaggccaaggccacccgcgaggcccagaagcggaccgcggccggcatcatgaagaaccccaccgtcgacgggatcgtggccatcgacctggaccccgtggtctacgacgccaagttcgagaagcagctcggccagatcatgctgctgatcctctgcacgtcccagatcctgctgatgcgcaccacctgggccctctgcgagagcatcaccctggcgacgggccccctgaccaccctctgggaggggtccccgggcaagttctggaacaccacgatcgccgtgagcatggccaacatcttccgggggagctacctggccggcgccggcctggcgttctccctcatgaagtccctcgggggcgggcgccgggggaccggggcccagggcgagaccctgggcgagaagtggaagcgccagctcaaccagctgtccaagagcgagttcaacacctacaagcggtccgggatcatggaggtggaccgcagcgaggccaaggagggcctgcggcgcggggagacgaccaagcacgccgtctcccggggcaccgcgaagctccgctggttcgtggagcggaacctggtgaagcccgaggggaaggtcatcgacctgggctgcggccgcgggggctggagctactactgcgccgggctgaagaaggtgaccgaggtgaagggctacacgaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgaccatcgaggagggccggacgctgcgcgtgctgaagatggtcgagccctggctccgggggaaccagttctgcatcaagatcctgaacccctacatgcccagcgtggtggagaccctggagcagatgcagcgcaagcacggcggcatgctcgtccggaacccgctgtcccgcaacagcacccacgagatgtactgggtgtcctgcgggaccggcaacatcgtgagcgccgtcaacatgacctcccgcatgctgctcaaccggttcacgatggcccaccgcaagcccacctacgagcgggacgtggacctgggggcgggcacccgccacgtggccgtcgagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggcagcgcctccagcatggtgaacggggtggtcaagctcctgaccaagccctgggacgtgatccccatggtgacccagatcgcgatgaccgacacgacccccttcggccagcagcgcgtcttcaaggagaaggtggacacccggaccccgaaggccaagcgcgggacggcccagatcatggaggtgaccgcccggtggctgtggggcttcctctcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctggtgcaccgcgagcgggagctgcacaagcaggggaagtgcgcgacgtgcgtgtacaacatgatgggcaagcgcgagaagaagctcggggagttcggcaaggccaaggggagccgggccatctggtacatgtggctgggcgcccgcttcctggagttcgaggccctcggcttcatgaacgaggaccactggttctcccgggagaacagcctgtccggggtcgagggcgaggggctgcacaagctcggctacatcctgcgcgacatcagcaagatccccgggggcaacatgtacgcggacgacaccgccggctgggacacccgcatcaccgaggacgacctgcagaacgaggccaagatcacggacatcatggagccggagcacgccctcctggccacctccatcttcaagctgacctaccagaacaaggtggtgcgggtccagcgccccgcgaagaacgggaccgtgatggacgtgatcagccggcgcgaccagcggggctccgggcaggtcggcacgtacggcctcaacaccttcaccaacatggaggcccagctgatccgccagatggagagcgaggggatcttctcccccagcgagctggagacccccaacctcgccgagcgggtgctggactggctggagaagtacggcgtggagcgcctcaagcggatggccatctccggggacgactgcgtcgtgaagccgatcgacgaccgcttcgccacggcgctgaccgccctgaacgacatgggcaaggtgcggaaggacatcccccagtgggagcccagcaaggggtggaacgactggcagcaggtccccttctgcagccaccacttccaccagctcatcatgaaggacggccgcgagatcgtggtgccgtgccggaaccaggacgagctggtcggccgcgcccgggtgtcccagggggccggctggagcctgcgcgagaccgcctgcctcgggaagtcctacgcgcagatgtggcagctgatgtacttccaccggcgcgacctgcggctcgccgccaacgccatctgcagcgcggtgcccgtcgactgggtgcccacctcccgcacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgggaggaccagtggtgcggcagcctcatcggcctgaccgcccgcgccacctgggccaccaacatccaggtggcgatcaaccaggtccggcgcctgatcgggaacgagaactacctcgactacatgacctccatgaagcggttcaagaacgagagcgaccccgagggcgccctgtggtga

SEQ ID NO: 8013 - RNA, 9879 nt, synthetic construct
  misc_feature 1..9879: note = derived and/or modified CDS sequence (opt1) from DENV-1__FJ639674__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacctgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccatgagcctgtccatgacgtgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacctggacggagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccaccttcatcatcgacgggcccaacacgccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacgtggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacccagacggccggcccctggcacctcgggaagctggagctggacttcgacctctgcgagggcaccaccgtggtcgtggacgagcactgcggcaaccgggggccgagcctgcgcaccacgaccgtgaccggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgacgggcaccctcgccgtgttcttcctgctgatcatggggcagctcacctggaacgacctgatccggctgtgcatcatggtcggcgcgaacgcctccgaccgcatggggatgggcaccacgtacctcgccctgatggccaccttcaagatgcgcccgatgttcgccgtggggctcctgttccggcgcctgaccagccgggaggtgctgctcctgaccatcgggctgtccctcgtcgcgagcgtggagctgcccaactccctggaggagctcggcgacgggctggccatgggcatcatgatcctgaagctcctgacggacttccagagccaccagctgtgggccaccctcctgtccctgaccttcatcaagaccacgttcagcctccactacgcctggaagaccatggcgatggtcctgtccatcgtgagcctgttccccctctgcctgtccaccaccagccagaagacgacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacacgctgaccatcctgctcaaggccaccctgctggccgtgagcggcgtgtacccgctctccatccccgccaccctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacacgatgtggcacgtgacccggggcgcggtcctgatgtaccaggggaagcgcctcgagccctcctgggccagcgtgaagaaggacctgatctcctacggcggcgggtggcggctgcagggcagctggaacaccggggaggaggtgcaggtcatcgccgtggagcccggcaagaaccccaagaacgtgcagaccgcccccgggacgttcaagacctccgagggcgaggtcggcgccatcgcgctcgacttcaagcccgggaccagcggcagccccatcgtgaaccgcgaggggaagatcgtgggcctgtacggcaacggggtcgtgaccacgtccggcacctacgtgagcgccatcgcccaggccaaggcgtcccaggaggggcccctgccggagatcgaggacgaggtcttccggaagcgcaacctcaccatcatggacctgcaccccggcagcgggaagacccggcgctacctgcccgccatcgtgcgggaggccatcaagcgcaagctccggacgctgatcctggccccgacccgcgtggtcgcctccgagatggcggaggccctcaagggcatgcccatccgctaccagaccaccgccgtcaagagcgagcacacgggcaaggagatcgtggacctgatgtgccacgccaccttcaccatgcggctgctctcccccgtccgcgtgcccaactacaacatgatcatcatggacgaggcccacttcaccgacccgagctccatcgcggcccgggggtacatcagcacgcgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagacggtgtggttcgtcccctccatcaagagcggcaacgacatcgccaactgcctgcggaagaacgggaagcgcgtgatccagctgtcccggaagaccttcgacaccgagtaccagaagaccaagaacaacgactgggactacgtggtcacgaccgacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacgcccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacgcagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgaccggcggggtcacgctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagaccacgaagaaggacctggggatcggccacgtggccgtcgagaaccaccaccacgccgccatgctggacgtggacctccaccccgcctccgcgtggaccctgtacgccgtggccaccaccatcatcacgcccatgatgcgccacaccatcgagaacaccaccgccaacatcagcctgacggccatcgcgaaccaggccgccatcctcatggggctggacaagggctggccgatctccaagatggacatcggcgtccccctgctcgccctggggtgctacagccaggtgaaccccctgaccctcaccgcggccgtgctgatgctggtcgcccactacgccatcatcggccccgggctccaggccaaggcgacccgggaggcccagaagcgcacggccgccggcatcatgaagaacccgaccgtggacgggatcgtggccatcgacctggaccccgtcgtgtacgacgcgaagttcgagaagcagctgggccagatcatgctcctgatcctgtgcacctcccagatcctcctgatgcgcaccacgtgggccctgtgcgagagcatcaccctcgccaccggccccctgaccacgctgtgggaggggtcccccggcaagttctggaacaccaccatcgccgtgagcatggccaacatcttccgggggagctacctcgcgggcgccggcctggccttctccctgatgaagtccctcgggggcgggcgccggggcaccggggcccagggcgagacgctgggcgagaagtggaagcgccagctgaaccagctctccaagagcgagttcaacacctacaagcggtccgggatcatggaggtcgaccgcagcgaggcgaaggagggcctgaagcgcggggagaccaccaagcacgccgtgtcccgcggcacggccaagctgcggtggttcgtggagcgcaacctcgtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggccacctacgggtggaacctggtgaagctccactccggcaaggacgtgttcttcatcccgcccgagaagtgcgacacgctgctgtgcgacatcggggagagctcccccaaccccaccatcgaggagggccgcaccctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacgcacgagatgtactgggtgtcctgcgggaccggcaacatcgtcagcgcggtgaacatgacctcccgcatgctgctgaaccggttcaccatggcccaccgcaagccgacctacgagcgcgacgtggacctcggggccggcacgcggcacgtcgccgtggagcccgaggtggccaacctggacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctcaccaagccgtgggacgtgatccccatggtcacgcagatcgccatgaccgacaccacccccttcggccagcagcgggtgttcaaggagaaggtggacacgcgcacccccaaggccaagcgggggaccgcccagatcatggaggtcaccgcgaagtggctgtggggcttcctgtcccgcaacaagaagccgcggatctgcacgcgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacgcggatcaccgaggacgacctgcagaacgaggccaagatcaccgacatcatggagcccgagcacgcgctgctcgccaagtccatcttcaagctgacctaccagaacaaggtggtccgcgtgcagcggccggtgaagaacgggacggtcatggacgtgatcagccgccgcgaccagcggggctccggccaggtgggcacctacggcctgaacaccttcaccaacatggaggcccagctcatccgccagatggagagcgaggggatcttctcccccagcgagctggagacgcccaacctggccggccgggtcctcgactggctggagaagcacggggtggagcgcctgaagcggatggccatctccggcgacgactgcgtggtcaagcccatcgacgaccgcttcgcgaccgccctcaccgccctgaacgacatggggaaggtgcggaaggacatcccgcagtgggagcccagcaagggctggaacgactggcagcaggtccccttctgcagccaccacttccaccagctgatcatgaaggacggccgcgagatcgtcgtgccctgccggaaccaggacgagctcgtggggcgcgcccgggtctcccagggcgccgggtggagcctgcgcgagaccgcgtgcctgggcaagtcctacgcccagatgtggcagctcatgtacttccaccggcgcgacctgcggctggccgccaacgcgatctgcagcgccgtgccggtggactgggtccccacgtcccgcaccacctggagcatccacgcccaccaccagtggatgaccacggaggacatgctctccgtgtggaaccgggtgtggatcgaggagaacccctggatggaggacaagacccacatcagctcctggggcgacgtcccctacctgggcaagcgcgaggaccagtggtgcggcagcctgatcgggctcaccgcccgggccacctgggcgacgaacatccaggtggccatcaaccaggtgcgccgcctgatcggcaacgagaactacctggactacatgacctccatgaagcggttcaagaacgagagcgacccggagggggccctctggtga

SEQ ID NO: 8014 - RNA, 9879 nt, synthetic construct
  misc_feature 1..9879: note = derived and/or modified CDS sequence (opt1) from DENV-1__FJ639675__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggctgttcaagctcgagaaggaggtggcggagacccagcacggcacggtgctggtccagatcaagtacgagggcaccgacgccccctgcaagatccccttcagcacccaggacgagaagggggtgacccagaacggccggctgatcacggccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccatcggcggcgtgttcacgagcgtcgggaagctggtgcaccagatcttcggcaccgcctacggggtgctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggcggacagcccgaagcgcctgtccagcgccatcggcaaggcctgggaggagggggtctgcggcatccggtccgccacccgcctggagaacatcatgtggaagcagatcagcaacgagctcaaccacatcctgctggagaacgacatgaagttcaccgtggtggtcggggacgtggccggcatcctcgcgcaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcctggaacatctgggaggtcgaggactacggcttcgggatcttcaccaccaacatctggctgaagctgcgggactcctacacccaggtgtgcgaccaccgcctcatgagcgcggccatcaaggactccaaggccgtgcacgccgacatgggctactggatcgagagcgagaagaacgagacctggaagctggcccgggcgtccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgccaacgcgtccgaccgcatggggatgggcatgacgtacctggccctgatggccaccttcaagatgcgcccgatgttcgccgtgggcctcctgttccggcgcctgaccagccgggaggtgctcctgctgaccatcgggctctccctggtcgccagcgtggagctgcccaactccctcgaggagctgggcgacgggctggcgatgggcatcatgatcctcaagctgctgacggacttccagagccaccagctctgggccaccctgctgtccctcaccttcatcaagaccacgttcagcctgcactacgcctggaagaccatggccatggtcctgtccatcgtgagcctcttccccctgtgcctgtccaccaccagccagaagacgacctggctccccgtgctgctgggctccctcgggtgcaagccgctgaccatgttcctgatcgcggagaacaagatctggggccgcaagagctggcccctcaacgaggggatcatggccgtcggcatcgtgagcatcctgctgtccagcctcctgaagaacgacgtgcccctggccgggcccctcatcgccggcggcatgctgatcgcctgctacgtcatctccgggagctccgcggacctgagcctcgagaaggccgccgaggtgtcctgggaggaggaggccgagcacagcggcgcctcccacaacatcctggtggaggtccaggacgacgggaccatgaagatcaaggacgaggagcgggacgacacgctgaccatcctcctgaaggcgaccctgctcgccgtgagcggcgtgtacccgctgtccatccccgccaccctgttcgtctggtacttctggcagaagaagaagcagcgcagcggggtgctctgggacacccccagcccgcccgaggtggagcgggccgtcctggacgacggcatctaccgcatcatgcagcggggcctgctggggcgcagccaggtgggcgtgggggtcttccaggagaacgtgttccacacgatgtggcacgtgacccggggcgccgtcctcatgtaccaggggaagcgcctggagccctcctgggcgagcgtgaagaaggacctgatctcctacggcggcgggtggcggctccagggcagctggaacaccggggaggaggtgcaggtcatcgccgtggagcccggcaagaaccccaagaacgtgcagaccgcccccgggacgttcaagacctccgagggcgaggtcggcgccatcgccctggacttcaagcccgggaccagcggcagccccatcgtgaaccgcgaggggaagatcgtgggcctgtacggcaacggggtcgtgaccacgtccggcacctacgtgagcgcgatcgcccaggccaaggcctcccaggaggggcccctcccggagatcgaggacgaggtcttccggaagcgcaacctgaccatcatggacctgcaccccggcagcgggaagacccggcgctacctccccgcgatcgtgcgggaggccatcaagcgcaagctgcggacgctgatcctcgccccgacccgcgtggtcgcctccgagatggccgaggcgctgaagggcatgcccatccgctaccagaccaccgccgtcaagagcgagcacacgggcaaggagatcgtggacctgatgtgccacgccaccttcaccatgcggctcctgtcccccgtccgcgtgcccaactacaacatgatcatcatggacgaggcccacttcaccgacccgagctccatcgccgcgcgggggtacatcagcacgcgcgtgggcatgggggaggccgccgccatcttcatgaccgccacgccgcccggctccgtcgaggcgttcccccagagcaacgccgtgatccaggacgaggagcgggacatcccggagcgctcctggaacagcgggtacgagtggatcaccgacttccccggcaagacggtgtggttcgtcccctccatcaagagcggcaacgacatcgccaactgcctgcggaagaacgggaagcgcgtgatccagctctcccggaagaccttcgacaccgagtaccagaagaccaagaacaacgactgggactacgtggtcacgaccgacatcagcgagatgggcgccaacttccgcgcggaccgggtgatcgacccccgccggtgcctgaagccggtgatcctgaaggacgggcccgagcgcgtcatcctcgccggccccatgcccgtgaccgtcgcctccgccgcccagcggcgcgggcggatcggccgcaaccacaacaaggagggcgaccagtacatctacatggggcagccgctgaacaacgacgaggaccacgcgcactggaccgaggccaagatgctgctcgacaacatcaacacgcccgagggcatcatccccgccctgttcgagcccgagcgggagaagtccgccgccatcgacggggagtaccgcctgcgcggcgaggcgcggaagaccttcgtggagctcatgcgccgcggggacctgccggtgtggctgagctacaaggtcgcctccgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtctccggggacctgatcctcgagatcggcaagctgccccagcacctgacgcagcgcgcccagaacgccctcgacaacctggtgatgctgcacaacagcgagcagggcgggcgggcctaccgccacgcgatggaggagctcccggacaccatcgagaccctgatgctgctcgccctgatcgccgtgctgaccggcggggtcaccctcttcttcctgtccggccgggggctgggcaagacgagcatcggcctcctgtgcgtgatggcctccagcgtgctgctctggatggcctccgtcgagccccactggatcgcggccagcatcatcctggagttcttcctgatggtgctcctgatccccgagcccgaccgccagcggaccccgcaggacaaccagctggcctacgtggtcatcgggctcctgttcatgatcctgaccgtggccgccaacgagatgggcctcctggagaccacgaagaaggacctggggatcggccacgtggcggtcgagaaccaccaccacgccgccatgctcgacgtggacctgcaccccgcctccgcctggaccctgtacgcggtggccaccaccatcatcacgcccatgatgcgccacaccatcgagaacaccaccgccaacatcagcctcacggccatcgccaaccaggcggccatcctgatggggctggacaagggctggccgatctccaagatggacatcggcgtccccctcctggccctggggtgctacagccaggtgaaccccctcaccctgaccgccgcggtgctgatgctcgtcgcccactacgccatcatcggccccgggctgcaggccaaggccacccgggaggcgcagaagcgcacggccgccggcatcatgaagaacccgaccgtggacgggatcgtggccatcgacctggaccccgtcgtgtacgacgccaagttcgagaagcagctcggccagatcatgctgctgatcctctgcacctcccagatcctgctgatgcgcaccacgtgggcgctctgcgagagcatcaccctggccaccggccccctgaccacgctctgggaggggtcccccggcaagttctggaacaccaccatcgccgtgagcatggccaacatcttccgggggagctacctggccggcgcgggcctggccttctccctcatgaagtccctcgggggcgggcgccgggggaccggggcccagggcgagacgctgggcgagaagtggaagcgccagctcaaccagctgtccaagagcgagttcaacacctacaagcggtccgggatcatggaggtcgaccgcagcgaggccaaggagggcctgaagcgcggggagaccaccaagcacgcggtgtcccgcggcacggccaagctccggtggttcgtggagcgcaacctggtcaagccggaggggaaggtgatcgacctgggctgcggccgcggcgggtggagctactactgcgccgggctgaagaaggtgaccgaggtcaaggggtacaccaagggcggccccggccacgaggagcccatccccatggccacctacgggtggaacctcgtgaagctgcactccggcaaggacgtgttcttcatcccgcccgagaagtgcgacacgctgctctgcgacatcggggagagctcccccaaccccaccatcgaggagggccgcaccctgcgggtcctgaagatggtggagccgtggctccgcgggaaccagttctgcatcaagatcctgaacccctacatgcccagcgtggtcgagaccctggagcagatgcagcggaagcacggcggcatgctcgtgcgcaaccccctgtcccggaacagcacgcacgagatgtactgggtgtcctgcgggaccggcaacatcgtcagcgccgtgaacatgacctcccgcatgctgctcaaccggttcaccatggcgcaccgcaagccgacctacgagcgcgacgtggacctgggggccggcacgcggcacgtcgccgtggagcccgaggtggccaacctggacatcatcggccagcgcatcgagaacatcaagcacgagcacaagagcacctggcactacgacgaggacaacccctacaagacctgggcctaccacgggtcctacgaggtcaagcccagcggcagcgcgtccagcatggtgaacggggtcgtgaagctcctgaccaagccgtgggacgtgatccccatggtcacgcagatcgccatgaccgacaccacccccttcggccagcagcgggtgttcaaggagaaggtggacacgcgcacccccaaggccaagcgggggaccgcccagatcatggaggtcaccgccaagtggctgtggggcttcctctcccgcaacaagaagccgcggatctgcacgcgcgaggagttcacccggaaggtgcgcagcaacgcggccatcggcgccgtgttcgtcgacgagaaccagtggaactccgccaaggaggcggtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacgcggatcaccgaggacgacctgcagaacgaggccaagatcaccgacatcatggagcccgagcacgccctcctggcgaagtccatcttcaagctgacctaccagaacaaggtggtccgcgtgcagcggccggccaagaacgggacggtgatggacgtcatcagccgccgcgaccagcggggctccggccaggtgggcacctacggcctcaacaccttcaccaacatggaggcccagctgatccgccagatggagagcgaggggatcttctcccccagcgagctggagacgcccaacctcgccgagcgggtgctggactggctggagaagcacggcgtcgagcgcctcaagcggatggccatctccggggacgactgcgtggtgaagcccatcgacgaccgcttcgcgaccgccctgaccgccctgaacgacatgggcaaggtccggaaggacatcccgcagtgggagcccagcaaggggtggaacgactggcagcaggtccccttctgcagccaccacttccaccagctcatcatgaaggacggccgcgagatcgtggtcccctgccggaaccaggacgagctggtgggccgcgcccgggtgtcccagggggccggctggagcctgcgcgagaccgcgtgcctcgggaagtcctacgcccagatgtggcagctgatgtacttccaccggcgcgacctgcggctcgccgccaacgcgatctgcagcgccgtcccggtggactgggtgcccacgtcccgcaccacctggagcatccacgcccaccaccagtggatgaccacggaggacatgctgtccgtctggaaccgggtgtggatcgaggagaacccctggatggaggacaagacccacatcagctcctggggcgacgtgccctacctggggaagcgcgaggaccagtggtgcggcagcctcatcggcctgaccgcccgggccacctgggcgacgaacatccaggtcgccatcaaccaggtgcgccgcctgatcgggaacgagaactacctcgactacatgacctccatgaagcggttcaagaacgagagcgacccggagggcgccctgtggtga

SEQ ID NO: 8015 - RNA, 9879 nt, synthetic construct
  misc_feature 1..9879: note = derived and/or modified CDS sequence (opt1) from DENV-1__FJ639676__SS-prME
  source 1..9879: mol_type = other RNA
agcgtgaccatgctgctgatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccgcatcaccgaggtggagcccgacgacgtcgactgctggtgcaacaccaccgacacctgggtgacctacgggacctgcagccagacgggcgagcaccggcgcgacaagcggtccgtggccctcgcgccccacgccggcctggggctggagacccgcgcggagacctggatgagctccgagggcgcctggaagcagatccagcgggtcgagacctgggccctccgccaccccgggttcacggtgatcgccctgttcctggcgcacgtgatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcggaagctctgcatcgaggcgaagatctccaacaccaccacggacagccgctgcccgacccagggcgaggccaccctggtcgaggagcaggacgccaacttcgtgtgccggcgcaccttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccggcaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccgcctcaagatggacaagctgaccctgaagggcatgtcctacgtgatgtgcaccgggagcttcaagctcgagaaggaggtggccgagacccagcacggcacggtcctggtgcagatcaagtacgagggcaccgacgcgccctgcaagatccccttctccacccaggacgagaagggggtgacccagaacggccggctgatcacggccaacccgatcgtcaccgacaaggagaagcccgtgaacatcgaggccgagccgcccttcggggagagctacatcgtgatcggcgccggcgagaaggcgctgaagctctcctggttcaagaaggggagctccatcggcaagatgttcgaggccaccgcccgcggggcccggcgcatggccatcctgggcgacaccgcgtgggacttcgggagcatcggcggcgtcttcacgtccgtggggaagctggtgcaccagatcttcggcaccgcctacggggtcctcttcagcggcgtgtcctggaccatgaagatcgggatcggcgtgctgctgacctggctcggcctgaacagccgctccacgagcctgtccatgacctgcatcgccgtcgggctcgtgaccctgtacctgggcgtgatggtccaggccgacagcgggtgcgtgatcaactggaagggccgggagctcaagtgcgggagcggcatcttcgtgaccaacgaggtccacacgtggaccgagcagtacaagttccaggccgactccccgaagcgcctgagcgcggccatcggcaaggcctgggaggagggggtgtgcggcatccggtccgccacccgcctggagaacatcatgtggcggcagatcagcaacgagctcaaccacatcctgctggagaacgacatgaagttcaccgtggtcgtgggggacgtggtcggcatcctcgcccaggggaagaagatgatccgcccccagcccatggagcacaagtactcctggaagtcctggggcaaggcgaagatcatcggcgccgacgtgcagaacaccacgttcatcatcgacgggcccaacaccccggagtgccccgacgaccagcgggcctggaacatctgggaggtggaggactacggcttcgggatcttcaccaccaacatctggctgaagctgcgcgactcctacacgcaggtctgcgaccaccggctcatgagcgccgcgatcaaggactccaaggccgtgcacgccgacatgggctactggatcgagagcgagaagaacgagacctggaagctggcccgcgcctccttcatcgaggtgaagacctgcatctggcccaagagccacaccctgtggtccaacggcgtcctcgagagcgagatgatcatccccaagatctacgggggcccgatctcccagcacaactaccggcccgggtacttcacgcagaccgcgggcccctggcacctggggaagctggagctcgacttcgacctgtgcgagggcaccaccgtggtggtcgacgagcactgcggcaaccgcgggccgagcctgcggacgaccaccgtgaccggcaagatcatccacgagtggtgctgccgctcctgcacgctgccgcccctccggttcaagggggaggacggctgctggtacgggatggagatccgccccgtgaaggagaaggaggagaacctggtcaagagcatggtgagcgccggctccggcgaggtggacagcttctccctcgggctgctgtgcatcagcatcatgatcgaggaggtcatgcggtcccgctggagccggaagatgctcatgaccggcaccctggccgtgttcttcctgctcatcgtggggcagctgacctggaacgacctgatccgcctctgcatcatggtcggcgccaacgcctccgaccgcatggggatgggcacgacctacctggcgctgatggccaccttcaagatgcggccgatgttcgccgtggggctcctgttccgccggctgaccagccgcgaggtcctcctgctgacgatcgggctctccctggtggccagcgtggagctgcccaactccctcgaggagctgggcgacgggctggccatgggcatcatgatcctcaagctgctgaccgacttccagagctaccagctctgggcgaccctgctgtccctcaccttcatcaagacgaccttcagcctgcactacgcctggaagaccatggccatggtcctgtccatcgtgagcctcctgcccctgtgcctctccaccacgagccagaagaccacctggctgcccgtgctgctcggctccctggggtgcaagccgctgaccatgttcttcatcgccgagaacaagatctggggccgcaagagctggcccctcaacgaggggatcatggcggtcggcatcgtgagcatcctgctgtccagcctcctgaagaacgacgtgcccctggccgggcccctcatcgccggcggcatgctgatcgcctgctacgtcatctccgggagctccgccgacctgagcctcgagaaggcggccgaggtgtcctgggaggaggaggccgagcacagcggcgcctcccacaacatcctggtggaggtccaggacgacgggacgatgaagatcaaggacgaggagcgcgacgacaccctgaccatcctcctgaaggccaccctgctcgcggtgagcggcgtgtacccgctgtccatccccgccaccctgttcgtctggtacttctggcagaagaagaagcagcggagcggggtgctctgggacacgcccagcccgcccgaggtggagcgcgccgtcctggacgacggcatctaccggatcatgcagcgcggcctgctggggcggagccaggtgggcgtgggggtcttccaggagaacgtgttccacaccatgtggcacgtgacccgcggcgccgtcctcatgtaccaggggaagcggctggagccctcctgggccagcgtgaagaaggacctgatctcctacggcggcgggtggcgcctccagggcagctggaacaccggggaggaggtgcaggtcatcgcggtggagcccggcaagaaccccaagaacgtgcagacggcccccgggaccttcaagacccccgagggcgaggtcggcgccatcgccctggacttcaagcccgggacctccggcagccccatcgtgaaccgggaggggaagatcgtgggcctgtacggcaacggggtcgtgacgaccagcggcacctacgtgtccgccatcgcgcaggccaaggccagccaggaggggccgctccccgagatcgaggacgaggtcttccgcaagcggaacctgaccatcatggacctgcaccccggctccgggaagacgcgccggtacctcccggccatcgtgcgcgaggcgatcaagcggaagctgcgcaccctgatcctcgcccccacccgcgtggtcgccagcgagatggccgaggccctgaagggcatgcccatccggtaccagaccacggcggtgaagtccgagcacaccggccgcgagatcgtggacctgatgtgccacgccaccttcaccatgcggctcctgagccccgtccgcgtgccgaactacaacatgatcatcatggacgaggcccacttcacggacccctccagcatcgccgcccgggggtacatctccacccgcgtgggcatgggggaggcggccgccatcttcatgaccgccacgccgcccggcagcgtcgaggccttcccgcagtccaacgcggtgatccaggacgaggagcgggacatccccgagcgcagctggaactccgggtacgagtggatcacggacttccccggcaagaccgtgtggttcgtccccagcatcaagtccggcaacgacatcgccaactgcctgcggaagaacgggaagcgcgtgatccagctcagccggaagaccttcgacaccgagtaccagaagacgaagaacaacgactgggactacgtggtcaccaccgacatctccgagatgggcgccaacttccgcgccgaccgggtgatcgacccgcgccggtgcctgaagcccgtcatcctgaaggacgggcccgagcgcgtgatcctcgcgggccccatgccggtgaccgtcgccagcgccgcccagcggcgcgggcggatcggccgcaaccacaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccggctgcgcggcgaggcccggaagaccttcgtggagctcatgcgccgcggggacctgcccgtgtggctgagctacaaggtcgcgagcgagggcttccagtactccgaccgccggtggtgcttcgacggcgagcgcaacaaccaggtgctcgaggagaacatggacgtggagatctggaccaaggagggggagcggaagaagctgcgcccccggtggctggacgcccgcacgtacagcgaccccctcgccctgcgggagttcaaggagttcgccgccggccgccggtccatcagcggggacctgatcctcgagatcggcaagctgccgcagcacctgacccagcgcgcgcagaacgccctcgacaacctggtcatgctgcacaactccgagcagggcgggcgggcctaccgccacgccatggaggagctccccgacaccatcgagaccctgatgctgctcgcgctgatcgccgtgctgacgggcggggtgaccctcttcttcctgagcggccgggggctgggcaagacctccatcggcctcctgtgcgtcatggccagctccgccctgctctggatggccagcgtggagccccactggatcgcggcctccatcatcctggagttcttcctgatggtgctcctgatccccgagccggaccgccagcggacgccccaggacaaccagctggcctacgtcgtgatcgggctcctgttcatgatcctgaccgtggccgccaacgagatgggcctcctggagacgaccaagaaggacctggggatcggccacgtcgcggtggagaaccaccaccacgccaccatgctcgacgtggacctgcaccccgccagcgcctggaccctgtacgccgtcgcgacgaccatcatcaccccgatgatgcgccacaccatcgagaacacgaccgccaacatctccctcaccgccatcgccaaccaggccgcgatcctgatggggctggacaagggctggcccatcagcaagatggacatcggcgtgcccctcctggccctggggtgctactcccaggtgaaccccctcaccctgacggccgccgtcctgatgctcgtggcgcactacgccatcatcggcccggggctgcaggccaaggccacccgcgaggcccagaagcggaccgcggccggcatcatgaagaaccccaccgtggacgggatcgtcgccatcgacctggaccccgtggtgtacgacgccaagttcgagaagcagctcggccagatcatgctgctgatcctctgcacgagccagatcctgctgatgcgcaccacctgggccctctgcgagtccatcaccctggcgacgggccccctgaccaccctctgggaggggagcccgggcaagttctggaacaccacgatcgccgtctccatggccaacatcttccgggggagctacctggccggcgccggcctggcgttcagcctcatgaagtccctcgggggcgggcgccgggggaccggggcccagggcgagaccctgggcgagaagtggaagcgccagctcaaccagctgagcaagtccgagttcaacacctacaagcggagcgggatcctggaggtggaccgctccgaggccaaggagggcctccggcgcggggagacgaccaagcacgccgtgagccggggcaccgcgaagctgcgctggttcgtcgagcggaacctggtgaagcccgaggggaaggtgatcgacctgggctgcggccgcgggggctggtcctactactgcgccgggctcaagaaggtcaccgaggtgaagggctacacgaagggcgggcccggccacgaggagcccatcccgatggccacctacgggtggaacctggtgaagctgcacagcggcaaggacgtcttcttcatcccgcccgagaagtgcgacaccctcctgtgcgacatcggggagtccagccccaacccgaccatcgaggagggccggacgctgcgcgtgctcaagatggtggagccctggctgcgggggaaccagttctgcatcaagatcctgaacccctacatgccctccgtcgtggagaccctcgagcagatgcagcgcaagcacggcggcatgctggtgcggaacccgctgagccgcaactccacccacgagatgtactgggtcagctgcgggaccggcaacatcgtgtccgccgtgaacatgaccagccgcatgctcctgaaccggttcacgatggcccaccgcaagcccacctacgagcgggacgtcgacctgggggcgggcacccgccacgtggccgtggagcccgaggtcgccaacctcgacatcatcggccagcggatcgagaacatcaagcacgagcacaagtccacctggcactacgacgaggacaacccctacaagacgtgggcctaccacgggagctacgaggtgaagccgtccggcagcgccagctccatggtcaacggggtggtgaagctgctgaccaagccctgggacgtcatccccatggtgacccagatcgcgatgaccgacacgacccccttcggccagcagcgcgtgttcaaggagaaggtcgacacccggaccccgaaggccaagcgcgggacggcccagatcatggaggtgaccgcccggtggctctggggcttcctgagccgcaacaagaagccccggatctgcacccgcgaggagttcacccggaaggtgcgctccaacgccgcgatcggcgccgtcttcgtggacgagaaccagtggaacagcgccaaggaggccgtggaggacgagcggttctgggacctggtccaccgcgagcgggagctccacaagcaggggaagtgcgcgacgtgcgtgtacaacatgatgggcaagcgcgagaagaagctgggggagttcggcaaggccaaggggtcccgggccatctggtacatgtggctgggcgcccgcttcctcgagttcgaggccctgggcttcatgaacgaggaccactggttcagccgggagaactccctgagcggggtggagggcgaggggctccacaagctgggctacatcctgcgcgacatctccaagatccccgggggcaacatgtacgcggacgacaccgccggctgggacacccgcatcaccgaggacgacctccagaacgaggccaagatcacggacatcatggagccggagcacgccctgctggccaccagcatcttcaagctcacctaccagaacaaggtcgtgcgggtgcagcgccccgcgaagaacgggaccgtcatggacgtgatctcccggcgcgaccagcggggcagcggccaggtgggcacgtacggcctgaacaccttcaccaacatggaggcccagctgatccgccagatggagtccgaggggatcttcagcccctccgagctcgagacccccaacctggccgagcgggtcctggactggctcgagaagtacggcgtggagcgcctgaagcggatggccatcagcggggacgactgcgtggtcaagccgatcgacgaccgcttcgccacggcgctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctggtgggccgcgcccgggtcagccagggggccggctggtccctccgcgagaccgcctgcctgggcaagagctacgcgcagatgtggcagctgatgtacttccaccggcgcgacctccggctggccgccaacgccatctgctccgcggtgcccgtggactgggtccccaccagccgcacgacctggtccatccacgcccaccaccagtggatgaccaccgaggacatgctgagcgtgtggaaccgcgtgtggatcgaggagaacccctggatggaggacaagacgcacatctccagctgggaggacgtcccgtacctcggcaagcgggaggaccagtggtgcgggtccctgatcggcctgaccgcccgcgccacctgggccaccaacatccaggtggcgatcaaccaggtgcggcgcctcatcggcaacgagaactacctggacttcatgaccagcatgaagcggttcaagaacgagtccgacacggagggggccctgtggtga

SEQ ID NO: 8016 - RNA, 9879 nt, synthetic construct
  misc_feature 1..9879: note = derived and/or modified CDS sequence (opt1) from DENV-1__FJ639677__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccgcgtgaccgaggccgagcccgacgacgtggactgctggtgcaacgccaccgacacgtgggtgacctacgggacctgcagccagaccggcgagcaccggcgcgacaagcggtccgtggccctcgcgccccacgtcggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgcggtgctgcggaagctctgcatcgaggccaagatctccaacaccaccacggacagccgctgcccgacccagggcgaggccaccctggtcgaggagcaggacgccaacttcgtgtgccggcgcaccttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtgcacaagcagtggttcctggacctgcccctcccctggaccagcggggccagcacctcccaggagacgtggaaccggcaggacctgctggtcaccttcaagaccgcccacgcgaagaagcaggaggtggtggtcctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtggcggagacgcagcacggcaccgtcctggtgcagatcaagtacgagggcaccgacgccccctgcaagatccccttcagcacccaggacgagaagggggtgacgcagaacggccggctgatcaccgccaacccgatcgtcaccgacaaggagaagcccgtgaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtcttcaccagcgtggggaagctggtgcaccagatcttcggcaccgcctacggggtcctcttctccggcgtgagctggaccatgaagatcgggatcggcgtgctgctgacgtggctcggcctgaactcccgcagcacctccctgagcatgacctgcatcgccgtcgggctcgtgaccctgtacctgggcgtgatggtccaggccgactccgggtgcgtgatcaactggaagggccgggagctcaagtgcgggagcggcatcttcgtgacgaacgaggtccacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagctcaccgtggtcgtgggggacgtggcgggcatcctggcccaggggaagaagatgatccggccccagcccatggagtacaagtacagctggaagtcctggggcaaggccaagatcatcggcgccgacgcgcagaacacgaccttcatcatcgacgggcccaacaccccggagtgccccgacgaccagcgcgcctggaacatctgggaggtcgaggactacggcttcgggatcttcaccacgaacatctggctgaagctccgggacagctacacccaggtgtgcgaccaccgcctgatgtccgccgccatcaaggacagcaaggccgtgcacgcggacatgggctactggatcgagtccgagaagaacgagacctggaagctggcccgggccagcttcatcgaggtcaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtcgtggacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcaccctggcggtgttcttcctcctgatcatggggcagctgacgtggaacgacctcatccgcctgtgcatcatggtcggcgccaacgccagcgaccgcatggggatgggcaccacctacctggccctcatggccaccttcaagatgcggccgatgttcgcgatgggcctgctgttccgccggctcacgtcccgcgaggtgctgctgctcaccatcgggctgagcctggtggcctccgtcgagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcgtggaagaccatggccatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggccggaagtcctggcccctgaacgaggggatcatggccgtgggcatcgtcagcatcctgctcagctccctgctgaagaacgacgtgcccctcgccgggcccctgatcgcgggcggcatgctgatcgcctgctacgtgatcagcgggtccagcgccgacctctccctggagaaggccgccgaggtcagctgggaggaggaggcggagcactccggcgccagccacaacatcctggtggaggtgcaggacgacgggaccatgaagatcaaggacgaggagcgcgacgacaccctcaccatcctgctgaaggccaccctcctggccgtctccggcgtgtacccgctgagcatccccgccaccctgttcgtgtggtacttctggcagaagaagaagcagcggtccggggtcctgtgggacacccccagcccgcccgaggtggagcgcgcggtgctggacgacggcatctaccggatcatgcagcgcggcctgctcgggcggtcccaggtcggcgtgggggtgttccaggagaacgtcttccacaccatgtggcacgtgacccgcggcgccgtgctgatgtaccaggggaagcggctggagcccagctgggcctccgtcaagaaggacctcatcagctacggcggcgggtggcgcctgaagggctcctggaacacgggggaggaggtccaggtgatcgccgtcgagcccggcaagaaccccaagaacgtgcagaccgcccccgggaccttcaagacccccgagggcgaggtgggcgcgatcgccctggacttcaagcccgggacgagcggctcccccatcgtcaaccgggaggggaagatcgtgggcctctacggcaacggggtggtcaccaccagcggcacctacgtgagcgccatcgcccaggcgaaggcctcccaggaggggccgctgcccgagatcgaggacgaggtgttccgcaagcggaacctgacgatcatggacctccaccccggcagcgggaagacccgccggtacctgccggccatcgtccgcgaggccatcaagcggaagctgcgcaccctcatcctggcccccacccgcgtggtggcgtccgagatggccgaggccctgaagggcatgcccatccggtaccagacgaccgccgtcaagagcgagcacaccggcaaggagatcgtggacctcatgtgccacgccaccttcacgatgcgcctgctgtcccccgtgcgggtcccgaactacaacatgatcatcatggacgaggcgcacttcaccgaccccagctccatcgccgcccgcgggtacatcagcacccgggtgggcatgggggaggccgccgcgatcttcatgaccgccacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgcgaactgcctccgcaagaacgggaagcgggtcatccagctgtcccgcaagaccttcgacacggagtaccagaagaccaagaacaacgactgggactacgtggtgaccaccgacatcagcgagatgggcgccaacttccgggccgaccgcgtcatcgacccgcggcgctgcctgaagcccgtgatcctcaaggacgggcccgagcgggtgatcctggccggccccatgccggtcacggtggcctccgcggcccagcgccgggggcgcatcggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgcggccatcgacggggagtaccgcctccggggcgaggcccgcaagaccttcgtcgagctgatgcggcgcggggacctgcccgtgtggctctcctacaaggtggccagcgagggcttccagtacagcgaccggcgctggtgcttcgacggcgagcggaacaaccaggtcctggaggagaacatggacgtggagatctggacgaaggagggggagcgcaagaagctgcggccccgctggctcgacgcccggacctactccgaccccctggcgctgcgcgagttcaaggagttcgccgccggccggcgcagcgtgtccggggacctcatcctggagatcggcaagctgccgcagcacctcacccagcgggcccagaacgcgctggacaacctggtcatgctccacaacagcgagcagggcgggcgcgcctaccggcacgccatggaggagctgcccgacaccatcgagacgctgatgctcctggccctgatcgccgtgctcaccggcggggtgaccctgttcttcctgtccggccgcgggctcggcaagaccagcatcggcctgctgtgcgtcatggcgtccagcgtgctcctgtggatggcctccgtggagccccactggatcgccgccagcatcatcctggagttcttcctcatggtcctgctgatccccgagccggaccggcagcgcacgccccaggacaaccagctcgcctacgtggtgatcgggctgctgttcatgatcctcacggtcgcggccaacgagatgggcctgctggagaccaccaagaaggacctcgggatcggccacgtggccgtggagaaccaccaccacgccgccatgctggacgtcgacctgcaccccgcgtccgcctggaccctctacgccgtggccacgaccatcatcaccccgatgatgcggcacaccatcgagaacacgaccgccaacatcagcctgaccgcgatcgccaaccaggccgccatcctgatggggctcgacaagggctggcccatctccaagatggacatcggcgtgcccctgctggcgctcgggtgctacagccaggtcaaccccctgaccctgacggccgccgtgctcatgctggtggcccactacgccatcatcggcccggggctgcaggcgaaggccacccgcgaggcccagaagcgcaccgccgccggcatcatgaagaaccccaccgtcgacgggatcgtggcgatcgacctcgaccccgtggtctacgacgccaagttcgagaagcagctgggccagatcatgctgctcatcctgtgcacgtcccagatcctgctcatgcggaccacctgggccctgtgcgagagcatcaccctggccacgggccccctcaccaccctgtgggaggggtccccgggcaagttctggaacaccacgatcgccgtgagcatggcgaacatcttccgcgggtcctacctggccggcgccggcctcgccttcagcctgatgaagtccctcgggggcgggcggcgcgggaccggggcgcagggcgagaccctcggcgagaagtggaagcggcagctgaaccagctgtccaagagcgagttcaacacctacaagcgctccgggatcatggaggtggaccggagcgaggccaaggagggcctcaagcgcggggagacgaccaagcacgccgtctcccggggcaccgccaagctgcgctggttcgtggagcggaacctggtgaagcccgaggggaaggtcatcgacctgggctgcggccgcgggggctggagctactactgcgccgggctcaagaaggtgaccgaggtgaagggctacacgaagggcggccccggccacgaggagcccatcccgatggcgacctacgggtggaacctggtcaagctgcactccggcaaggacgtgttcttcatcccgcccgagaagtgcgacaccctcctgtgcgacatcggggagagctcccccaacccgaccatcgaggagggccggacgctgcgcgtgctcaagatggtcgagccctggctgcgggggaaccagttctgcatcaagatcctgaacccctacatgcccagcgtggtggagaccctcgagcagatgcagcgcaagcacggcggcatgctggtccggaacccgctgtcccgcaacagcacccacgagatgtactgggtgtcctgcgggaccggcaacatcgtgagcgccgtcaacatgacctcccggatgctcctgaaccgcttcacgatggcccaccgcaagcccacctacgagcgggacgtggacctggggaccggcacccgccacgtggccgtcgagcccgaggtggccaacctcgacatcatcggccagcggatcgagaacatcaagcacgagcacaagagcacgtggcactacgacgaggacaacccctacaagacctgggcgtaccacgggtcctacgaggtgaagccgagcggctccgccagcagcatggtcaacggggtggtcaagctgctgaccaagccctgggacgtgatccccatggtgacccagatcgccatgacggacaccacccccttcggccagcagcgcgtcttcaaggagaaggtggacacccggacgccgaaggccaagcgcgggaccgcccagatcatggaggtgaccgcgcggtggctctggggcttcctgtcccgcagcaagaagccccggatctgcacccgcgaggagttcatccggaaggtccgctccaacgccgccatcggcgccgtgttcgtggacgagaaccagtggaacagcgcgaaggaggccgtcgaggacgagcggttctgggacctggtgcaccgcgagcgggagctccacaagcaggggaagtgcgccacgtgcgtgtacaacatgatgggcaagcgcgagaagaagctgggggagttcggcaaggccaaggggtcccgggccatctggtacatgtggctgggcgcgcgcttcctcgagttcgaggccctgggcttcatgaacgaggaccactggttcagccgggagaactccctgagcggggtcgagggcgaggggctccacaagctgggctacatcctgcgcgacatctccaagatccccgggggcaacatgtacgccgacgacaccgccggctgggacacccggatcaccgaggacgacctccagaacgaggccaagatcacggacatcatggagccggagcacgcgctgctggccaaggccatcttcaagctcacctaccagaacaaggtggtgcgcgtccagcgccccgccaagaacgggaccgtgatggacgtgatcagccggcgcgaccagcggggctccgggcaggtcggcacctacggcctgaacacgttcaccaacatggaggcccagctgatccgccagatggagagcgaggggatcttctcccccagcgagctcgagacccccaacctggcggagcgggccctggactggctcgagaagtacggcgtggagcgcctgaagcggatggccatctccggggacgactgcgtggtcaagccgatcgacgaccgcttcgccaccgccctgacggcgctcaacgacatgggcaaggtgcggaaggacatcccccagtgggagcccagcaaggggtggaacgactggcagcaggtccccttctgctcccaccacttccaccagctgatcatgaaggacggccgcgagatcgtcgtgccgtgccggaaccaggacgagctggtgggccgcgcccgggtcagccagggggccggctggagcctccgcgagaccgcctgcctggggaagtcctacgcgcagatgtggcagctgatgtacttccaccggcgcgacctccggctggccgccaacgccatctgcagcgccgtgcccgtggactgggtccccacctcccgcaccacgtggagcatccacgcgcaccaccagtggatgaccaccgaggacatgctgtccgtgtggaaccgggtgtggatcgaggagaacccctggatggaggacaagacccacatcagctcctgggaggacgtcccgtacctcggcaagcgcgaggaccagtggtgcgggagcctgatcggcctgacggcccgcgccacctgggccaccaacatccaggtggccatcaaccaggtgcggcgcctcatcggcaacgagaactacctggactacatgacctccatgaagcggttcaagaacgagagcgaccccgagggggcgctgtggtga

SEQ ID NO: 8017 - RNA, 9879 nt, synthetic construct
  misc_feature 1..9879: note = derived and/or modified CDS sequence (opt1) from DENV-1__GQ868618__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtgggcctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggacgatgaagatcaaggacgaggagcgggacgacaccctgaccatcctgctcaaggccaccctgctggccgtgagcggcgtgtacccgctctccatccccgccaccctgttcgtctggtacttctggcagaagaagaagcagcgcagcggggtgctgtgggacacgcccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacaccggggaggaggtgcaggtcatcgccgtggagcccggcaagaaccccaagaacgtgcagacggcccccgggaccttcaagacctccgagggcgaggtcggcgccatcgcgctcgacttcaagcccgggaccagcggcagccccatcgtgaaccgcgaggggaagatcgtgggcctgtacggcaacggggtcgtgacgacctccggcacctacgtgagcgccatcgcccaggccaaggcgtcccaggaggggcccctgccggagatcgaggacgaggtcttccggaagcgcaacctcaccatcatggacctgcaccccggcagcgggaagacgcggcgctacctgcccgccatcgtgcgggaggccatcaagcgcaagctccggaccctgatcctggccccgacccgcgtggtcgcctccgagatggcggaggccctcaagggcatgcccatccgctaccagaccacggccgtcaagagcgagcacaccggcaaggagatcgtggacctgatgtgccacgccaccttcaccatgcggctgctctcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctgcggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgacgggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagacgaccaagaaggacctggggatcggccacgtggccgtcgagaaccaccaccacgccgccatgctggacgtggacctccaccccgcctccgcgtggaccctgtacgccgtggccaccacgatcatcacccccatgatgcgccacaccatcgagaacaccacggccaacatcagcctgaccgccatcgcgaaccaggccgccatcctcatggggctggacaagggctggccgatctccaagatggacatcggcgtccccctgctcgccctggggtgctacagccaggtgaaccccctgaccctcaccgcggccgtgctgatgctggtcgcccactacgccatcatcggccccgggctccaggccaaggcgacgcgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtgagcatggccaacatcttccgggggagctacctcgcgggcgccggcctggccttctccctgatgaagtccctcgggggcgggcgccggggcacgggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagaccacgaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggccacgtacgggtggaacctggtgaagctccactccggcaaggacgtgttcttcatcccgcccgagaagtgcgacaccctgctgtgcgacatcggggagagctcccccaaccccaccatcgaggagggccgcaccctccgggtcctgaagatggtggagccgtggctgcgcgggaaccagttctgcatcaagatcctcaacccctacatgcccagcgtggtcgagacgctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcaccatggcccaccgcaagccgacgtacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacacggccggctgggacacccggatcaccgaggacgacctgcagaacgaggccaagatcaccgacatcatggagcccgagcacgcgctgctcgccaagtccatcttcaagctgacgtaccagaacaaggtggtccgcgtgcagcggccggccaagaacgggaccgtgatggacgtcatcagccgccgcgaccagcggggctccggccaggtgggcacctacggcctgaacaccttcacgaacatggaggcccagctcatccgccagatggagagcgaggggatcttctcccccagcgagctggagacccccaacctggccgagcgggtgctcgactggctggagaagcacggcgtcgagcgcctgaagcggatggcgatctccggggacgactgcgtggtgaagcccatcgacgaccgcttcgccaccgccctcaccgccctgaacgacatgggcaaggtccggaaggacatcccgcagtgggagcccagcaaggggtggaacgactggcagcaggtccccttctgcagccaccacttccaccagctgatcatgaaggacggccgcgagatcgtggtcccctgccggaaccaggacgagctcgtgggccgcgcccgggtgtcccagggggcgggctggagcctgcgcgagacggcctgcctggggaagtcctacgcccagatgtggcagctcatgtacttccaccggcgcgacctgcggctggccgcgaacgccatctgcagcgccgtcccggtggactgggtgcccacctcccgcaccacctggagcatccacgcccaccaccagtggatgacgaccgaggacatgctctccgtctggaaccgggtgtggatcgaggagaacccctggatggaggacaagacccacatcagctcctggggcgacgtgccctacctggggaagcgcgaggaccagtggtgcggcagcctgatcggcctcaccgcccgggcgacgtgggccaccaacatccaggtcgccatcaaccaggtgcgccgcctgatcgggaacgagaactacctggactacatgacctccatgaagcggttcaagaacgagagcgacccggagggcgccctctggtga

SEQ ID NO: 8018 - RNA, 9879 nt, synthetic construct
  misc_feature 1..9879: note = derived and/or modified CDS sequence (opt1) from DENV-1__GQ868619__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggcccaggggaagaagatgatccggccccagcccatggagtacaagtacagctggaagtcctggggcaaggccaagatcatcggcgccgacgcgcagaacacgaccttcatcatcgacgggcccaacaccccggagtgccccgacgaccagcgcgcctggaacatctgggaggtggaggactacggcttcgggatcttcaccacgaacatctggctgaagctccgggacagctacacccaggtctgcgaccaccgcctgatgtccgccgccatcaaggacagcaaggccgtgcacgcggacatgggctactggatcgagtccgagaagaacgagacctggaagctggcccgggccagcttcatcgaggtgaagacctgcatctggcccaagtcccacacgctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtggtcgacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcaccctggtggtgttcttcctcctgatcatggggcagctgacgtggaacgacctcatccgcctgtgcatcatggtcggcgcgaacgccagcgaccgcatggggatgggcaccacctacctggccctcatggccaccttcaagatgcggccgatgttcgccgtgggcctgctgttccgccggctcacgtcccgcgaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtcctcagcatcgtgtccctgttccccctgtgcctcagcacgacctcccagaagaccacctggctgcccgtgctgctcggcagcctggggtgcaagccgctgacgatgttcctcatcgccgagaacaagatctggggccggaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacaccctcaccatcctgctgaaggccaccctcctggccgtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacaccatgtggcacgtgacccgcggcgcggtcctgatgtaccaggggaagcggctggagcccagctgggcctccgtgaagaaggacctcatcagctacggcggcgggtggcgcctgcagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctctacggcaacggggtcgtgaccaccagcggcacctacgtgagcgccatcgcccaggccaaggcgtcccaggaggggccgctgcccgagatcgaggacgaggtcttccgcaagcggaacctgacgatcatggacctccaccccggcagcgggaagacccgccggtacctgccggccatcgtgcgcgaggccatcaagcggaagctgcgcaccctcatcctggcccccacccgcgtggtcgcctccgagatggcggaggccctgaagggcatgcccatccggtaccagacgaccgccgtcaagagcgagcacaccggcaaggagatcgtggacctcatgtgccacgccaccttcacgatgcgcctgctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccatggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctccgcaagaacgggaagcgggtcatccagctgtcccgcaagaccttcgacacggagtaccagaagaccaagaacaacgactgggactacgtggtgaccaccgacatcagcgagatgggcgcgaacttccgggccgaccgcgtcatcgacccgcggcgctgcctgaagcccatcatcctcaaggacgggcccgagcgggtgatcctggccggccccatgccggtgacggtcgcctccgccgcgcagcgccgggggcgcatcggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccgcctccggggcgaggcccgcaagaccttcgtggagctgatgcggcgcggggacctgcccgtctggctctcctacaaggtggccagcgagggcttccagtacagcgaccggcgctggtgcttcgacggcgagcggaacaaccaggtgctggaggagaacatggacgtcgagatctggacgaaggagggggagcgcaagaagctgcggccccgctggctcgacgcccggacctactccgaccccctggccctgcgcgagttcaaggagttcgcggccggccggcgcagcgtgtccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtcctcaccggcggggtgatgctgttcttcctgtccggccgcgggctcggcaagaccagcatcggcctgctgtgcgtgatggcctccagcgggctcctgtggatggcgtccgtcgagccccactggatcgccgccagcatcatcctggagttcttcctcatggtgctgctgatccccgagccggaccggcagcgcacgccccaggacaaccagctcgcctacgtggtcatgggcctgctgttcatgatcctcaccgtggccgcgaacgagatggggctgctggagacgaccaagaaggacctcggcatcgggcacgtggccgtcgagaaccaccaccacgccgccatgctggacgtggacctgcaccccgcctccgcgtggaccctctacgccgtggccaccacgatcatcaccccgatgatgcggcacaccatcgagaacaccacggccaacatcagcctgaccgccatcgcgaaccaggccgccatcctgatgggcctcgacaagggctggcccatctccaagatggacatcggggtccccctgctggccctcggctgctacagccaggtgaaccccctgaccctgaccgcggccgtgctcatgctggtcgcccactacgccatcatcgggccgggcctgcaggccaaggcgacgcgcgaggcccagaagcgcaccgccgccgggatcatgaagaaccccaccgtggacggcatcgtggccatcgacctcgaccccgtcgtgtacgacgcgaagttcgagaagcagctgggccagatcatgctgctcatcctgtgcacctcccagatcctgctcatgcggacgacctgggccctgtgcgagagcatcaccctggccaccgggcccctcacgaccctgtgggagggctccccggggaagttctggaacaccaccatcgccgtgagcatggccaacatcttccgcggctcctacctggcgggcgccgggctcgccttcagcctgatgaagtccctgggcgggggccggcgcgggacgggcgcccagggcgagaccctcggggagaagtggaagcggcagctgaaccagctgtccaagagcgagttcaacacctacaagcgctccggcatcatggaggtcgaccggagcgaggcgaaggaggggctcaagcgcggcgagaccacgaagcacgccgtgtcccgggggaccgccaagctgcgctggttcgtggagcggaacctggtcaagcccgagggcaaggtgatcgacctgggctgcgggcgcggcgggtggagctactactgcgccggcctcaagaaggtgaccgaggtcaaggggtacaccaagggcggccccgggcacgaggagcccatcccgatggccacgtacggctggaacctggtgaagctgcactccgggaaggacgtgttcttcatcccgcccgagaagtgcgacaccctcctgtgcgacatcggcgagagctcccccaacccgaccatcgaggaggggcggaccctgcgcgtcctcaagatggtggagccctggctgcggggcaaccagttctgcatcaagatcctgaacccctacatgcccagcgtggtcgagacgctcgagcagatgcagcgcaagcacggcgggatgctggtgcggaacccgctgtcccgcaacagcacccacgagatgtactgggtgtcctgcggcaccgggaacatcgtcagcgcggtgaacatgacctcccggatgctcctgaaccgcttcaccatggcccaccgcaagcccacgtacgagcgggacgtggacctgggcaccggcacccgccacgtcgccgtggagcccgaggtggccaacctcgacatcatcgggcagcggatcgagaacatcaagcacgagcacaagagcacctggcactacgacgaggacaacccctacaagacgtgggcctaccacggctcctacgaggtcaagccgagcgggtccgcgagcagcatggtgaacggcgtggtcaagctgctgaccaagccctgggacgtgatccccatggtcacccagatcgccatgaccgacacgacccccttcgggcagcagcgcgtgttcaaggagaaggtggacacccggaccccgaaggccaagcgcggcacggcccagatcatggaggtcaccgcccggtggctctggggcttcctgtcccgcaacaagaagccccggatctgcacccgcgaggagttcacccggaaggtgcgcagcaacgcggccatcggggccgtgttcgtcgacgagaaccagtggaactccgccaaggaggcggtggaggacgagcggttctgggacctggtgcaccgcgagcgggagctccacaagcagggcaagtgcgccacgtgcgtctacaacatgatggggaagcgcgagaagaagctgggcgagttcgggaaggccaagggcagccgggccatctggtacatgtggctgggcgcccgcttcctcgagttcgaggcgctggggttcatgaacgaggaccactggttctcccgggagaacagcctgtccggcgtggagggggagggcctccacaagctggggtacatcctgcgcgacatcagcaagatccccggcggcaacatgtacgccgacgacaccgccgggtgggacacccggatcaccgaggacgacctccagaacgaggccaagatcacggacatcatggagccggagcacgccctgctggcgaaggccatcttcaagctcacctaccagaacaaggtggtccgcgtgcagcgccccgccaagaacggcaccgtgatggacgtcatctcccggcgcgaccagcgggggagcggccaggtgggcacctacgggctgaacacgttcaccaacatggaggcccagctgatccgccagatggagtccgagggcatcttcagcccctccgagctcgagacccccaacctggccgagcgggcgctggactggctcgagaagtacggggtggagcgcctgaagcggatggccatcagcggcgacgactgcgtcgtgaagccgatcgacgaccgcttcgccaccgccctgacggccctcaacgacatggggaaggtgcggaaggacatcccccagtgggagccctccaagggctggaacgactggcagcaggtccccttctgcagccaccacttccaccagctgatcatgaaggacggccgcgagatcgtggtgccgtgccggaaccaggacgagctggtcgggcgcgcgcgggtgtcccagggcgccgggtggagcctccgcgagaccgcctgcctgggcaagagctacgcccagatgtggcagctgatgtacttccaccggcgcgacctccggctggcggccaacgccatctgctccgccgtgcccgtcgactgggtgcccaccagccgcaccacgtggtccatccacgcccaccaccagtggatgaccaccgaggacatgctgagcgtgtggaaccgggtctggatcgaggagaacccctggatggaggacaagacccacatctccagctgggaggacgtgccgtacctcgggaagcgcgaggaccagtggtgcggctccctgatcggcctgacggcgcgcgccacctgggccaccaacatccaggtggccatcaaccaggtccggcgcctcatcgggaacgagaactacctggactacatgaccagcatgaagcggttcaagaacgagtccgaccccgagggcgccctgtggtga

SEQ ID NO: 8019 - RNA, 9879 nt, synthetic construct
  misc_feature 1..9879: note = derived and/or modified CDS sequence (opt1) from DENV-1__FJ639678__SS-prME
  source 1..9879: mol_type = other RNA
agcgtgaccatgctgctcatgctgatgcccaccgccctggccttccacctcaccacccggggcggggagccgcacatgatcgtgagcaagcaggagcgggggaaggcgctgctgttcaagaccagcgccggggtgaacatgtgcaccctcatcgccatggacctgggcgagctgtgcgaggacaccatgacctacaagtgcccccggatcaccgaggtggagcccgacgacgtcgactgctggtgcaacgccaccgacacctgggtgacctacgggacctgcccccagaccggcgagcaccggcgcgaccggcgctccgtggccctcgcgccccacgtcggcctggggctggagacccgggccgagacctggatgagctccgagggcgcctggaagcagatccagcgcgtggagacctgggccctccggcaccccgggttcaccgtgatcgcgctgttcctggcccacgccatcggcacgagcatcacccagaaggggatcatcttcatcctcctgatgctggtcaccccctccatggccatgcgctgcgtgggcatcggcaaccgggacttcgtggaggggctcagcggcgccacctgggtcgacgtggtgctggagcacgggtcctgcgtcacgaccatggcgaaggacaagcccaccctggacatcgagctcctgaagaccgaggtgacgaacccggccgtgctgcgcaagctctgcatcgaggccaagatcagcaacaccaccaccgactcccggtgccccacgcagggcgaggccaccctggtcgaggagcaggacgccaacttcgtgtgccgccggaccttcgtggaccgcggctgggggaacggctgcgggctgttcggcaaggggagcctcatcacgtgcgcgaagttcaagtgcgtcacgaagctggagggcaagatcgtgcagtacgagaacctgaagtactccgtgatcgtcaccgtgcacaccggcgaccagcaccaggtcgggaacgagagcaccgagcacggcacgaccgccaccatcacgccccaggcccccacctccgagatccagctcacggactacggggccctgaccctggactgcagcccgcggaccggcctcgacttcaacgagatggtgctgctgaccatgaaggagaagtcctggctcgtgcacaagcagtggttcctggacctgcccctcccctggacgagcggggcctccaccagccaggagacctggaaccgccaggacctgctggtcaccttcaagacggcgcacgccaagaagcaggaggtggtggtcctcggcagccaggagggcgccatgcacaccgccctgaccggggccaccgagatccagacgtccggcaccaccaccatcttcgcggggcacctgaagtgccggctcaagatggacaagctgacgctgaagggcatgagctacgtgatgtgcaccgggtccttcaagctcgagaaggaggtggccgagacccagcacggcaccgtcctggtgcagatcaagtacgagggcacggacgccccctgcaagatcccgttcagcacccaggacgagaagggggtgacccagaacggccgcctgatcaccgccaaccccatcgtcacggacaaggagaagcccgtgaacatcgaggcggagcccccgttcggggagtcctacatcgtgatcggcgccggcgagaaggccctgaagctcagctggttcaagaaggggtccagcatcggcaagatgttcgaggccaccgcccgcggggcccgccgcatggccatcctgggcgacaccgcctgggacttcgggtccatcggcggcgtcttcaccagcgtggggaagctggtgcaccagatcttcggcacggcctacggggtcctcttctccggcgtgagctggaccatgaagatcgggatcggcgtgctgctgacctggctcggcctgaactcccggagcacctccctgagcatgacgtgcatcgccgtcgggctcgtgaccctgtacctgggcgtgatggtccaggcggactccgggtgcgtgatcaactggaagggccgcgagctcaagtgcgggagcggcatcttcgtgaccaacgaggtccacacctggacggagcagtacaagttccaggccgactcccccaagcggctgagcgccgccatcggcaaggcctgggaggagggggtgtgcggcatccgcagcgcgacccggctggagaacatcatgtggaagcagatctccaacgagctcaaccacatcctgctggagaacgacatgaagttcaccgtggtcgtgggggacgtggtcggcatcctcgcccaggggaagaagatgatccgcccccagcccatggagtacaagtacagctggaagtcctggggcaaggccaagatcatcggcgccgacatccagaacaccaccttcatcatcgacgggccgaacacgcccgagtgccccgacgaccagcgggcgtggaacatctgggaggtggaggactacggcttcgggatcttcaccaccaacatctggctgaagctgcgcgacagctacacccaggtgtgcgaccaccggctcatgtccgccgccatcaaggacagcaaggccgtccacgccgacatgggctactggatcgagtccgagaagaacgagacgtggaagctggcgcgcgccagcttcatcgaggtgaagacctgcatctggcccaagtcccacaccctgtggagcaacggcgtgctcgagtccgagatgatcatcccgaagatctacgggggccccatcagccagcacaactaccggcccgggtacttcacccagacggccggcccgtggcacctggggaagctggagctcgacttcgacctgtgcgagggcaccaccgtcgtggtggacgagcactgcggcaaccgcgggccctccctgcggaccacgaccgtcaccggcaagatcatccacgagtggtgctgccgcagctgcaccctgccgcccctccggttcaagggggaggacggctgctggtacgggatggagatccgcccggtgaaggagaaggaggagaacctggtgaagtccatggtcagcgccggctccggcgaggtggacagcttcagcctcgggctgctgtgcatctccatcatgatcgaggaggtgatgcggagccgctggtcccggaagatgctcatgacgggcaccctggccgtcttcttcctgctcatcatggggcagctgacctggaacgacctgatccgcctctgcatcatggtgggcgcgaacgccagcgaccgcatggggatgggcaccacgtacctggccctgatggccaccttcaagatgcggcccatgttcgccgtgggcctcctgttccgccggctgacctcccgcgaggtcctcctgctgaccatcgggctcagcctggtggcgtccgtcgagctgcccaacagcctcgaggagctgggcgacgggctggccatgggcatcatgatcctcaagctgctgacggacttccagtcccaccagctctgggccaccctgctgagcctcaccttcatcaagaccacgttctccctgcactacgcctggaagaccatggcgatggtgctgagcatcgtgtccctcctgcccctgtgcctcagcaccacctcccagaagacgacctggctgccggtcctgctcggcagcctggggtgcaagcccctgaccatgttcctcatcgccgagaacaagatctggggccggaagtcctggcccctgaacgaggggatcatggccgtgggcatcgtgagcatcctgctctccagcctgctgaagaacgacgtccccctcgccgggccgctgatcgccggcggcatgctgatcgcgtgctacgtgatcagcgggtccagcgccgacctctccctggagaaggccgccgaggtgagctgggaggaggaggccgagcactccggcgcgagccacaacatcctggtcgaggtgcaggacgacgggaccatgaagatcaaggacgaggagcgcgacgacacgctcaccatcctgctgaaggccaccctcctggccgtgtccggcgtctaccccctgagcatccccgccaccctcttcctgtggtacttctggcagaagaagaagcagcggtccggggtgctgtgggacacccccagcccgcccgaggtggagcgcgccgtcctggacgacggcatctaccggatcatgcagcgcggcctcctggggcggtcccaggtgggcgtgggggtcttccaggagaacgtgttccacacgatgtggcacgtgacccgcggcgcggtcctgatgtaccaggggaagcggctcgagcccagctgggcctccgtgaagaaggacctgatcagctacggcggcgggtggcgcctgcagggctcctggaacaccggggaggaggtgcaggtcatcgccgtggagcccggcaagaacccgaagaacgtgcagaccgcccccgggacgttcaagacccccgagggcgaggtcggcgccatcgcgctcgacttcaagcccgggaccagcggctccccgatcgtgaaccgggaggggaagatcgtgggcctgtacggcaacggggtcgtgaccacgagcggcacctacgtgtccgccatcgcccaggccaaggcgagccaggaggggcccctgcccgagatcgaggacgaggtcttccgcaagcggaacctcaccatcatggacctgcacccgggcagcgggaagacccgccggtacctgcccgccatcgtgcgcgaggccatcaagcggaagctccgcacgctgatcctggcccccacccgcgtggtcgcctccgagatggcggaggccctcaagggcatgcccatccggtaccagaccaccgccgtcaagagcgagcacacgggcaaggagatcgtggacctgatgtgccacgccaccttcaccatgcgcctgctctccccggtccgggtgcccaactacaacatgatcatcatggacgaggcccacttcaccgaccccagctccatcgcggcccgcgggtacatcagcacgcgggtgggcatgggggaggccgccgccatcttcatgaccgcgacgccgcccggctccgtcgaggccttcccccagagcaacgccgtgatccaggacgaggagcgcgacatccccgagcggtcctggaacagcgggtacgagtggatcaccgacttccccggcaagacggtgtggttcgtcccctccatcaagagcggcaacgacatcgccaactgcctgcgcaagaacgggaagcgggtgatccagctgtcccgcaagaccttcgacaccgagtaccagaagaccaagaacaacgactgggactacgtggtcacgaccgacatcagcgagatgggcgcgaacttccgggccgaccgcgtgatcgacccccggcgctgcctcaagcccgtgatcctgaaggacgggcaggagcgggtcatcctggccggccccatgccggtgaccgtcgcctccgccgcgcagcgccgggggcgcatcggccggaaccacaacaaggagggcgaccagtacatctacatggggcagcccctcaacaacgacgaggaccacgcccactggaccgaggccaagatgctgctggacaacatcaacacgcccgagggcatcatccccgccctcttcgagccggagcgcgagaagtccgccgcgatcgacggggagtaccgcctgcggggcgaggcccgcaagaccttcgtggagctgatgcggcgcggggacctccccgtgtggctgtcctacaaggtcgccagcgagggcttccagtactccgaccggcgctggtgcttcgacggcgagcggaacaaccaggtgctggaggagaacatggacgtggagatctggaccaaggagggggagcgcaagaagctccggccccgctggctggacgcccggacctacagcgaccccctggccctccgcgagttcaaggagttcgcggccggccggcgcagcgtctccggggacctgatcctggagatcggcaagctcccgcagcacctgacgcagaaggcccagaacgccctggacaacctcgtgatgctgcacaacagcgagcagggcgggcgggcgtaccgccacgccatggaggagctgcccgacaccatcgagaccctcatgctgctggccctcatcgccgtgctgaccggcggggtcacgctgttcttcctctccggccgggggctgggcaagaccagcatcggcctgctctgcgtgatggcctccagcgcgctgctgtggatggcctccgtggagccccactggatcgccgccagcatcatcctcgagttcttcctgatggtcctgctcatccccgagccggaccgccagcggacgccccaggacaaccagctggcctacgtggtgatcgggctcctgttcatgatcctgaccgtcgcggccaacgagatgggcctgctcgagaccacgaagaaggacctggggatcggccacgtggccgtggagaaccaccaccacgccaccatgctggacgtcgacctccaccccgcctccgcgtggaccctgtacgccgtggccaccacgatcatcaccccgatgatgcgccacaccatcgagaacaccacggccaacatcagcctgaccgccatcgcgaaccaggccgccatcctcatggggctggacaagggctggcccatctccaagatggacatcggcgtgcccctgctcgccctggggtgctacagccaggtcaaccccctgaccctcaccgcggccgtgctgatgctggtggcccactacgccatcatcggcccggggctccaggccaaggcgacgcgggaggcccagaagcgcaccgccgccggcatcatgaagaaccccaccgtcgacgggatcgtggccatcgacctggaccccgtggtctacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtccccgggcaagttctggaacaccaccatcgccgtgagcatggccaacatcttccgggggtcctacctcgcgggcgccggcctggccttcagcctgatgaagtccctcgggggcgggcgccggggcacgggggcccagggcgagaccctgggcgagaagtggaagcgccagctgaaccagctcagcaagagcgagttcaacacctacaagcggtccgggatcatggaggtggaccgcagcgaggcgaaggagggcctgaagcgcggggagaccacgcgccacgccgtctcccggggcaccgccaagctgcgctggttcgtggagcggaacctggtgaagcccgaggggaaggtcatcgacctcggctgcggccgcgggggctggagctactactgcgccgggctgaagaaggtgaccgaggtgaagggctacaccaagggcgggcccggccacgaggagcccatcccgatggccacgtacgggtggaacctggtcaagctccactccggcaaggacgtgttcttcatcccgcccgagaagtgcgacaccctgctgtgcgacatcggggagagctcccccaacccgaccatcgaggagggccggaccctccgcgtgctgaagatggtcgagccctggctgcgggggaaccagttctgcatcaagatcctcaacccctacatgcccagcgtggtggagacgctggagcagatgcagcgcaagcacggcggcatgctggtccggaacccgctctcccgcaacagcacccacgagatgtactgggtgtcctgcgggaccggcaacatcgtgagcgcggtcaacatgacctcccggatgctgctgaaccgcttcaccatggcccaccgcaagcccacgtacgagcgggacgtggacctcggggccggcacccgccacgtggccgtcgagcccgaggtggccaacctggacatcatcggccagcggatcgagaacatcaagcacgagcacaagagcacctggcactacgacgaggacaacccctacaagacctgggcgtaccacgggtcctacgaggtgaagccgagcggctccgccagctccatggtcaacggggtggtcaagctgctcacgaagccctgggacgtgatccccatggtgacccagatcgccatgaccgacaccacgcccttcggccagcagcgcgtcttcaaggagaaggtggacacccggaccccgaaggccaagcaggggaccgcccagatcatggaggtgacggcgcgctggctgtggggcttcctgagccggaacaagaagccccgcatctgcacccgggaggagttcacccgcaaggtccggagcaacgccgccatcggcgccgtgttcgtggacgagaaccagtggaactccgcgaaggaggccgtcgaggacgagcgcttctgggacctcgtgcaccgggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcgcggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgccgacgacacggccggctgggacacccgcatcaccgaggacgacctgcggaacgaggccaagatcaccgacatcatggagccggagcacgcgctgctcgccacgtccatcttcaagctgacctaccagaacaaggtggtgcgcgtccagcgccccgccaagaacgggaccgtgatggacgtgatcagccggcgcgaccagcggggctccgggcaggtcggcacctacggcctgaacacgttcaccaacatggaggcccagctcatccgccagatggagagcgaggggatcttctcccccagcgagctggagacccccaacctggccgagcgggtgctcgactggctggagaagtacggcgtggagcgcctgaagcggatggcgatctccggggacgactgcgtcgtgaagccgatcgacgaccgcttcgccaccgccctcacggccctgaacgacatgggcaaggtgcggaaggacatcccccagtgggagcccagcaaggggtggaacgactggcagcaggtccccttctgctcccaccacttccaccagctgatcatgaaggacggccgcgagatcgtggtgccgtgccggaaccaggacgagctcgtcggccgcgcccgggtgagccagggggcgggctggtccctgcgcgagaccgcctgcctgggcaagagctacgcccagatgtggcagctcatgtacttccaccggcgcgacctgcggctggccgcgaacgccatctgcagcgccgtgcccgtcgactgggtgcccacctcccgcaccacgtggagcatccacgcccaccaccagtggatgaccaccgaggacatgctctccgtgtggaaccgggtctggatcgaggagaacccctggatggaggacaagacccacatcagctcctgggaggacgtgccgtacctgggcaagcgcgaggaccagtggtgcgggagcctgatcggcctcacggcccgcgcgacctgggccaccaacatccaggtggccatcaaccaggtccggcgcctgatcggcaacgagaactacctggactacatgacctccatgaagcggttcaagaacgagagcgaccccgagggggccctctggtga

SEQ ID NO: 8020 - RNA, 9879 nt, synthetic construct
  misc_feature 1..9879: note = derived and/or modified CDS sequence (opt1) from DENV-1__FJ639679__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctgcgggacagctacacccaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggccgtgttcctgctcctgatcatggggcagctgacgtggaacgacctcatccgcctgtgcatcatggtgggcgcgaacgccagcgaccgcatggggatgggcaccacctacctggccctcatggccaccttcaagatgcggccgatgttcgccgtcgggctgctgttccgccggctcacgtcccgcgaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcgtgctacgtgatcagcgggtccagcgccgacctctccctggagaaggccgccgaggtcagctgggaggaggaggccgagcactccggcgcgagccacaacatcctggtggaggtgcaggacgacgggaccatgaagatcaaggacgaggagcgggacgacaccctcaccatcctgctgaaggccaccctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacccggggcgcggtgctgatgtaccaggggaagcgcctggagcccagctgggcctccgtcaagaaggacctcatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgcgaggggaagatcgtgggcctctacggcaacggggtggtcaccaccagcggcacctacgtgagcgccatcgcccaggccaaggcgtcccaggaggggccgctgcccgagatcgaggacgaggtgttccggaagcgcaacctgacgatcatggacctccaccccggcagcgggaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctcaaggacgggcccgagcgcgtgatcctggccggccccatgccggtcacggtggcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggacgaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtcatgctccacaacagcgagcagggcgggcgggcgtaccgccacgccatggaggagctgcccgacaccatcgagacgctgatgctcctggccctgatcgccgtgctcaccggcggggtgaccctgttcttcctgtccggccgggggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccgccagcggacgccccaggacaaccagctcgcctacgtggtgatcgggctgctgttcatgatcctcacggtcgccgcgaacgagatgggcctgctggagaccaccaagaaggacctcgggatcggccacgtggccgtggggaaccaccaccacgccgccatgctggacgtcgacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtgcccctgctggccctcggctgctacagccaggtcaaccccctgaccctgacggcggccgtgctcatgctggtggcccactacgccatcatcgggccgggcctgcaggccaaggcgacccgcgaggcccagaagcggaccgccgccgggatcatgaagaaccccaccgtcgacggcatcgtggccatcgacctcgaccccgtggtctacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtggaccgcagcgaggcgaaggaggggctcaagcggggcgagacgaccaagcacgccgtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacacgaagggcggccccgggcacgaggagcccatcccgatggccacctacggctggaacctggtcaagctgcactccgggaaggacgtgttcttcatcccgcccgagaagtgcgacaccctcctgtgcgacatcggcgagagctcccccaacccgaccatcgaggaggggcgcacgctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccggaacagcacccacgagatgtactgggtgtcctgcggcaccgggaacatcgtgagcgcggtcaacatgacctcccgcatgctcctgaaccgcttcacgatggcccaccggaagcccacctacgagcgcgacgtggacctgggcgccggcacccggcacgtggccgtcgagcccgaggtggccaacctcgacatcatcgggcagcgcatcgagaacatcaagcacgagcacaagagcacctggcactacgacgaggacaacccctacaagacgtgggcgtaccacggctcctacgaggtgaagccgagcgggtccgccagcagcatggtcaacggcgtggtcaagctgctgaccaagccctgggacgtgatccccatggtgacccagatcgccatgaccgacacgacccccttcgggcagcagcgggtcttcaaggagaaggtggacacccgcaccccgaaggccaagcggggcacggcccagatcatggaggtgaccgcgaagtggctctggggcttcctgtcccgcaacaagaagccccggatctgcacccgcgaggagttcacccggaaggtccgcagcaacgccgccatcggggccgtgttcgtggacgagaaccagtggaactccgcgaaggaggccgtcgaggacgagcggttctgggacctggtgcaccgcgagcgggagctccacaagcagggcaagtgcgccacgtgcgtgtacaacatgatggggaagcgcgagaagaagctgggcgagttcgggaaggccaagggcagccgggccatctggtacatgtggctgggcgcgcgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgccgacgacaccgccgggtgggacacccggatcaccgaggacgacctccagaacgaggcccgcatcacggacatcatggagccggagcacgcgctgctggccaagtccatcttcaagctcacctaccagaacaaggtggtgcgcgtccagcggcccgccaagaacggcaccgtgatggacgtgatcagccgccgggaccagcgcgggtccggccaggtcggcacctacgggctgaacacgttcaccaacatggaggcccagctgatccggcagatggagagcgagggcatcttctcccccagcgagctcgagacccccaacctggccgcgcgcgtgctggactggctcgagaagtacggggtggagcggctgaagcgcatggccatctccggcgacgactgcgtcgtgaagccgatcgacgaccggttcgccaccgccctgacggccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcgcgcgtgagccagggcgccgggtggagcctccgggagaccgcctgcctgggcaagtcctacgcccagatgtggcagctgatgtacttccaccgccgggacctccgcctggcggccaacgccatctgcagcgccgtgcccgtcgactggatccccacctcccggaccacgtggagcatccacgcccaccaccagtggatgaccaccgaggacatgctgtccgtgtggaaccgcgtgtggatcgaggagaacccctggatggaggacaagacccacatcagctcctggggcgacgtcccgtacctcggcaagcgcgaggaccagtggtgcggcagcctgatcgggctgacggcgcgggccacctgggccaccaacatccaggtggccatcaaccaggtgcgccggctcatcggcaacgagaactacctggactacatgacctccatgaagcgcttcaagaacgagagcgaccccgagggggccctgtggtga

SEQ ID NO: 8021 - RNA, 9879 nt, synthetic construct
  misc_feature 1..9879: note = derived and/or modified CDS sequence (opt1) from DENV-1__FJ850069__SS-prME
  source 1..9879: mol_type = other RNA
agcgtgaccatgctgctcatgctgatgcccaccgccctggccttccacctcaccacccgcggcggggagccccacatgatcgtgggcaagcaggagcggggcaagagcctgctgttcaagaccagcgccggggtgaacatgtgcaccctcatcgccatggacctgggggagctgtgcgaggacacgatgacctacaagtgcccccgcatcaccgaggtggagcccgacgacgtggactgctggtgcaacaccacggacacctgggtgacctacgggacctgcagccagacgggcgagcaccggcgcgacaagcggagcgtggccctcgcgccccacgtcgggctgggcctggagacccgcgccgagacctggatgtccagcgagggggcgtggaagcagatccagcgggtggagacctgggccctccgccaccccggcttcacggtgatcgccctgttcctggcccacgtcatcgggacctccatcacccagaagggcatcatcttcatcctcctgatgctggtgacccccagcatggcgatgcggtgcgtgggcatcgggtcccgcgacttcgtcgagggcctcagcggggccacgtgggtggacgtggtcctggagcacggctcctgcgtgaccaccatggccaaggacaagcccaccctggacatcgagctcctgaagacggaggtgaccaaccccgccgtcctgcggaagctctgcatcgaggccaagatcagcaacaccaccacggactcccgctgcccgacccagggcgaggcgaccctggtggaggagcaggacgccaacttcgtgtgccggcgcaccttcgtcgaccgggggtggggcaacgggtgcggcctgttcgggaagggcagcctcatcacgtgcgccaagttcaagtgcgtgaccaagctggagggcaagatcgtgcagtacgagaacctgaagtactccgtcatcgtgaccgtccacaccggggaccagcaccaggtgggcaacgagagcacggagcacgggaccaccgccaccatcacgccccaggcccccacgtccgagatccagctcaccgactacggcgcgctgaccctggactgcagcccccgcaccgggctcgacttcaacgagatggtgctgctgacgatgaaggagaagtcctggctcgtccacaagcagtggttcctggacctgcccctcccctggaccagcggcgccagcacctcccaggagacctggaaccggcaggacctgctggtgacgttcaagaccgcccacgccaagaagcaggaggtggtcgtgctcggcagccaggagggggccatgcacaccgcgctgaccggcgccacggagatccagacctccgggaccaccacgatcttcgccggccacctgaagtgccgcctcaagatggacaagctgaccctgaaggggatgagctacgtgatgtgcaccggctccttcaagctcgagaaggaggtcgccgagacccagcacggcacggtgctggtgcagatcaagtacgaggggaccgacgccccctgcaagatccccttcagcacccaggacgagaagggcgtcacccagaacgggcggctgatcacggcgaacccgatcgtgaccgacaaggagaagcccgtgaacatcgaggccgagccgcccttcggcgagtcctacatcgtcatcggcgccggggagaaggccctgaagctcagctggttcaagaagggctccagcatcgggaagatgttcgaggcgaccgcccgcggcgcccggcgcatggccatcctgggggacaccgcctgggacttcggctccatcggcggggtgttcacgagcgtgggcaagctggtccaccagatcttcgggaccgcgtacggcgtcctcttctccggggtgagctggaccatgaagatcggcatcggcgtcctgctgacctggctcgggctgaactcccgcagcacgtccctgagcatgacctgcatcgccgtgggcctcgtgaccctgtacctgggggtcatggtgcaggccgactccggctgcgtgatcaactggaaggggcgggagctcaagtgcggcagcggcatcttcgtcaccaacgaggtgcacacgtggaccgagcagtacaagttccaggccgacagcccgaagcgcctgtccgccgcgatcgggaaggcctgggaggagggcgtgtgcgggatccggagcgccacccgcctggagaacatcatgtggcggcagatctccaacgagctcaaccacatcctgctggagaacgacatgaagttcaccgtcgtggtgggcgacgtcgtggggatcctcgcccagggcaagaagatgatccgcccccagcccatggagcacaagtacagctggaagtcctggggcaaggccaagatcatcggggcggacgtgcagaacaccacgttcatcatcgacggccccaacaccccggagtgccccgacgaccagcgggcctggaacatctgggaggtcgaggactacgggttcggcatcttcaccaccaacatctggctgaagctgcgcgacagctacacccaggtgtgcgaccaccggctcatgtccgccgccatcaaggacagcaaggcggtgcacgccgacatgggctactggatcgagtccgagaagaacgagacctggaagctggcccgcgccagcttcatcgaggtcaagacctgcatctggcccaagtcccacaccctgtggagcaacggggtgctcgagtccgagatgatcatccccaagatctacggcgggccgatcagccagcacaactaccggcccggctacttcacgcagaccgccgggccctggcacctgggcaagctggagctcgacttcgacctgtgcgagggcaccaccgtggtcgtggacgagcactgcgggaaccgcggcccgtccctgcggacgaccaccgtgaccgggaagatcatccacgagtggtgctgccgcagctgcacgctgccgcccctccggttcaagggcgaggacgggtgctggtacggcatggagatccgccccgtcaaggagaaggaggagaacctggtgaagtccatggtgagcgcgggcagcggggaggtcgactccttcagcctcggcctgctgtgcatctccatcatgatcgaggaggtgatgcggagccgctggtcccggaagatgctcatgaccgggaccctggccgtgttcttcctgctcatcatgggccagctgacctggaacgacctgatccgcctctgcatcatggtcggggccaacgccagcgaccgcatgggcatgggcacgacctacctggccctgatggcgaccttcaagatgcggccgatgttcgccgtggggctcctgttccgccggctgacctcccgcgaggtcctcctgctgacgatcggcctcagcctggtggcctccgtggagctgcccaacagcctcgaggagctgggggacggcctggccatgggcatcatgatcctcaagctgctgaccgacttccagtcctaccagctctgggtcaccctgctgagcctcaccttcatcaagacgaccttctccctgcactacgcctggaagaccatggcgatggtgctgagcatcgtgtccctcctgcccctgtgcctcagcaccacgtcccagaagaccacctggctgcccgtcctgctcgggagcctgggctgcaagccgctgaccatgttcttcatcgccgagaacaagatctgggggcggaagtcctggcccctcaacgagggcatcatggccgtggggatcgtgagcatcctgctgagctccctcctgaagaacgacgtccccctggccggccccctcatcgcgggcgggatgctgatcgcctgctacgtgatcagcggctccagcgccgacctgtccctcgagaaggccgccgaggtgagctgggaggaggaggcggagcactccggggccagccacaacatcctggtcgaggtgcaggacgacggcacgatgaagatcaaggacgaggagcgcgacgacaccctgaccatcctcctgaaggccaccctgctcgccgtgtccggggtctacccgctgagcatccccgccaccctgttcgtgtggtacttctggcagaagaagaagcagcggtccggcgtgctctgggacacgcccagcccgcccgaggtcgagcgcgcggtgctggacgacggcatctaccggatcatgcagcgcgggctgctgggccggtcccaggtgggggtcggcgtgttccaggagaacgtgttccacaccatgtggcacgtcacccgcggggccgtgctcatgtaccagggcaagcggctggagcccagctgggcctccgtgaagaaggacctgatcagctacggcgggggctggcgcctccaggggtcctggaacaccggcgaggaggtccaggtgatcgccgtggagcccgggaagaaccccaagaacgtccagacggcccccggcaccttcaagacccccgagggcgaggtgggggcgatcgccctggacttcaagcccggcaccagcgggtcccccatcgtgaaccgggagggcaagatcgtcggcctgtacgggaacggcgtggtgacgaccagcgggacctacgtcagcgccatcgcccaggccaaggcgtcccaggagggcccgctccccgagatcgaggacgaggtgttccgcaagcggaacctgaccatcatggacctgcaccccgggagcggcaagacgcgccggtacctcccggccatcgtgcgcgaggccatcaagcggaagctgcgcaccctgatcctcgcccccacccgcgtcgtggcgtccgagatggccgaggccctgaagggcatgcccatccggtaccagaccacggccgtcaagagcgagcacaccgggcgcgagatcgtcgacctgatgtgccacgccaccttcaccatgcggctcctgtcccccgtgcgcgtgccgaactacaacatgatcatcatggacgaggcgcacttcacggaccccagctccatcgccgcccggggctacatcagcacccgcgtcgggatgggcgaggccgccgcgatcttcatgaccgccacgccgcccgggtccgtggaggccttcccgcagagcaacgccgtgatccaggacgaggagcgggacatccccgagcgctcctggaacagcggctacgagtggatcacggacttccccggcaagaccgtctggttcgtgccctccatcaagagcgggaacgacatcgccaactgcctgcggaagaacggcaagcgcgtgatccagctctcccggaagaccttcgacaccgagtaccagaagacgaagaacaacgactgggactacgtcgtgaccaccgacatcagcgagatgggggcgaacttccgcgccgaccgggtcatcgacccgcgccggtgcctgaagcccgtgatcctgaaggacggccccgagcgcgtgatcctcgccgggcccatgccggtcaccgtggcctccgcggcccagcggcgcggccggatcggccgcaaccacaacaaggagggggaccagtacatctacatgggccagcccctgaacaacgacgaggaccacgcccactggacggaggccaagatgctgctcgacaacatcaacacccccgaggggatcatccccgccctgttcgagccggagcgcgagaagtccgcggccatcgacggcgagtaccggctgcgcggggaggcccggaagaccttcgtggagctcatgcgccggggcgacctgcccgtctggctgtcctacaaggtggccagcgagggcttccagtacagcgaccgccggtggtgcttcgacggggagcgcaacaaccaggtgctcgaggagaacatggacgtcgagatctggaccaaggagggcgagcggaagaagctgcgcccccggtggctggacgcccgcacgtactccgaccccctcgcgctgcgggagttcaaggagttcgccgccgggcgccggagcatctccggcgacctgatcctcgagatcggcaagctgccgcagcacctgacccagcgcgcccagaacgccctcgacaacctggtgatgctgcacaacagcgagcagggcggccgggcgtaccgccacgccatggaggagctccccgacaccatcgagaccctgatgctgctcgccctgatcgccgtgctgaccgggggcgtcaccctcttcttcctgtccgggcggggcctgggcaagaccagcatcgggctcctgtgcgtgatggcgtccagcgccctgctctggatggcctccgtggagccccactggatcgccgccagcatcatcctggagttcttcctgatggtcctcctgatccccgagccggaccgccagcggacgccccaggacaaccagctggcgtacgtggtgatcggcctcctgttcatgatcctgaccgtcgccgccaacgagatggggctcctggagacgaccaagaaggacctgggcatcgggcacgtggccgtggagaaccaccaccacgccaccatgctcgacgtcgacctgcaccccgcgtccgcctggaccctgtacgccgtggccacgaccatcatcaccccgatgatgcgccacaccatcgagaacacgaccgccaacatcagcctcaccgcgatcgccaaccaggccgccatcctgatgggcctggacaagggctggcccatctccaagatggacatcggggtgcccctcctggccctgggctgctacagccaggtcaaccccctcaccctgacggcggccgtgctgatgctcgtggcccactacgccatcatcgggccgggcctgcaggcgaaggccacccgcgaggcccagaagcggaccgccgccgggatcatgaagaaccccaccgtcgacggcatcgtggcgatcgacctggaccccgtggtctacgacgccaagttcgagaagcagctcggccagatcatgctgctgatcctctgcacgtcccagatcctgctgatgcgcaccacctgggccctctgcgagagcatcaccctggccacggggcccctgaccaccctctgggagggctccccggggaagttctggaacaccacgatcgccgtgagcatggcgaacatcttccggggctcctacctggccggcgccgggctggccttcagcctcatgaagtccctgggcgggggccgccgggggaccggcgcccagggcgagaccctgggggagaagtggaagcgccagctcaaccagctgtccaagagcgagttcaacacctacaagcggtccggcatcctggaggtggaccgcagcgaggcgaaggaggggctccggcgcggcgagacgaccaagcacgccgtctcccgggggaccgccaagctgcgctggttcgtggagcggaacctggtgaagcccgagggcaaggtcatcgacctgggctgcgggcgcggcgggtggagctactactgcgccggcctcaagaaggtgaccgaggtgaaggggtacacgaagggcggccccgggcacgaggagcccatcccgatggcgacctacggctggaacctggtcaagctgcactccgggaaggacgtgttcttcatcccgcccgagaagtgcgacaccctcctgtgcgacatcggcgagagctcccccaacccgaccatcgaggaggggcggacgctgcgcgtgctcaagatggtcgagccctggctgcggggcaaccagttctgcatcaagatcctgaacccctacatgcccagcgtggtggagaccctcgagcagatgcagcgcaagcacggcgggatgctggtccggaacccgctgtcccgcaacagcacccacgagatgtactgggtgtcctgcggcaccgggaacatcgtgagcgccgtcaacatgacctcccgcatgctcctgaaccggttcacgatggcccaccgcaagcccacctacgagcgggacgtggacctgggcgccggcacccgccacgtggccgtcgagcccgaggtggcgaacctcgacatcatcgggcagcggatcgagaacatcaagcacgagcacaagagcacctggcactacgacgaggacaacccctacaagacgtgggcctaccacggctcctacgaggtcaagccgagcgggtccgccagcagcatggtgaacggcgtggtcaagctgctgaccaagccctgggacgtgatccccatggtgacccagatcgccatgaccgacacgacccccttcgggcagcagcgcgtcttcaaggagaaggtggacacccggaccccgaaggccaagcgcggcacggcgcagatcatggaggtgaccgccggctggctctgggggttcctgtcccggaacaagaagccccgcatctgcacccgggaggagttcacccgcaaggtccggagcaacgccgccatcggcgccgtgttcgtggacgagaaccagtggaactccgcgaaggaggccgtcgaggacgagcgcttctgggacctggtgcaccgggagcgcgagctccacaagcaggggaagtgcgccacgtgcgtgtacaacatgatgggcaagcgggagaagaagctgggggagttcggcaaggccaagggcagccgcgcgatctggtacatgtggctgggggcccggttcctcgagttcgaggccctgggcttcatgaacgaggaccactggttctcccgcgagaacagcctgtccggggtcgagggcgaggggctccacaagctgggctacatcctgcgggacatcagcaagatccccggcgggaacatgtacgccgacgacaccgccggctgggacacccgcatcaccgaggacgacctccagaacgaggcgaagatcacggacatcatggagccggagcacgccctgctggccacctccatcttcaagctcacctaccagaacaaggtggtgcgcgtccagcggcccgccaagaacgggaccgtgatggacgtgatcagccgccgggaccagcgcggctccggccaggtcgggacgtacggcctgaacaccttcaccaacatggaggcccagctgatccggcagatggagagcgaggggatcttctcccccagcgagctcgagacccccaacctggcggagcgcgtgctggactggctcgagaagtacggcgtggagcggctgaagcgcatggccatctccggggacgactgcgtcgtgaagccgatcgacgaccggttcgccacggccctgaccgccctcaacgacatgggcaaggtgcgcaaggacatcccccagtgggagcccagcaagggctggaacgactggcagcaggtccccttctgctcccaccacttccaccagctgatcatgaaggacgggcgggagatcgtggtgccgtgccgcaaccaggacgagctggtcggccgggcgcgcgtgagccagggggccggctggagcctccgggagaccgcctgcctggggaagtcctacgcccagatgtggcagctgatgtacttccaccgccgggacctccgcctggccgcgaacgccatctgcagcgccgtgcccgtcgactgggtgcccacctcccggacgacctggagcatccacgcccaccaccagtggatgaccaccgaggacatgctgtccgtgtggaaccgcgtctggatcgaggagaacccctggatggaggacaagacgcacatcagctcctgggaggacgtgccgtacctcggcaagcgcgaggaccagtggtgcggcagcctgatcgggctgaccgcgcgggccacctgggccaccaacatccaggtggccatcaaccaggtccgccggctcatcggcaacgagaactacctggactacatgacctccatgaagcgcttcaagaacgagagcgacacggagggggccctgtggtga

SEQ ID NO: 8022 - RNA, 9879 nt, synthetic construct
  misc_feature 1..9879: note = derived and/or modified CDS sequence (opt1) from DENV-1__FJ639680__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggcccaggggaagaagatgatccggccccagcccatggagtacaagtacagctggaagtcctggggcaaggccaagatcatcggcgccgacgcgcagaacacgaccttcatcatcgacgggcccaacaccccggagtgccccgacgaccagcgcgcctggaacatctgggaggtggaggactacggcttcgggatcttcaccacgaacatctggctgaagctccgggacagctacacccaggtctgcgaccaccgcctgatgtccgccgccatcaaggacagcaaggccgtgcacgcggacatgggctactggatcgagtccgagaagaacgagacctggaagctggcccgggccagcttcatcgaggtgaagacctgcatctggcccaagtcccacacgctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtggtcgacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcaccctggcggtgttcttcctcctgatcatggggcagctgacgtggaacgacctcatccgcctgtgcatcatggtgggcgccaacgccagcgaccgcatggggatgggcaccacctacctggccctcatggccaccttcaagatgcggccgatgttcgcggtcggcctgctgttccgccggctcacgtcccgcgaggtgctgctgctcaccatcgggctgagcctggtggcctccgtcgagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcgtggaagaccatggccatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggccggaagtcctggcccctgaacgaggggatcatggccgtgggcatcgtcagcatcctgctcagctccctgctgaagaacgacgtgcccctcgccgggcccctgatcgcgggcggcatgctgatcgcctgctacgtgatcagcgggtccagcgccgacctctccctggagaaggccgccgaggtcagctgggaggaggaggcggagcactccggcgccagccacaacatcctggtggaggtgcaggacgacgggaccatgaagatcaaggacgaggagcgcgacgacaccctcaccatcctgctgaaggccaccctcctggccgtctccggcgtgtacccgctgagcatccccgccaccctcttcgtgtggtacttctggcagaagaagaagcagcggtccggggtcctgtgggacacccccagcccgcccgaggtggagcgcgcggtgctggacgacggcatctaccggatcatgcagcgcggcctgctcgggcggtcccaggtcggcgtgggggtgttccaggagaacgtcttccacaccatgtggcacgtgacccgcggcgccgtgctgatgtaccaggggaagcggctggagcccagctgggcctccgtcaagaaggacctcatcagctacggcggcgggtggcgcctgcagggctcctggaacacgggggaggaggtccaggtgatcgccgtcgagcccggcaagaaccccaagaacgtgcagaccgcccccgggaccttcaagacccccgagggcgaggtgggcgcgatcgccctggacttcaagcccgggacgagcggctcccccatcgtcaaccgggaggggaagatcgtgggcctctacggcaacggggtggtcaccaccagcggcacctacgtgagcgccatcgcccaggcgaaggcctcccaggaggggccgctgcccgagatcgaggacgaggtgttccgcaagcggaacctgacgatcatggacctccaccccggcagcgggaagacccgccggtacctgccggccatcgtccgcgaggccatcaagcggaagctgcgcaccctcatcctggcccccacccgcgtggtggcgtccgagatggccgaggccctgaagggcatgcccatccggtaccagacgaccgccgtcaagagcgagcacaccggcaaggagatcgtggacctcatgtgccacgccaccttcacgatgcgcctgctgtcccccgtgcgggtcccgaactacaacatgatcatcatggacgaggcgcacttcaccgaccccagctccatcgccgcccgcgggtacatcagcacccgggtgggcatgggggaggccgccgcgatcttcatgaccgccacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgcgaactgcctccgcaagaacgggaagcgggtcatccagctgtcccgcaagaccttcgacacggagtaccagaagaccaagaacaacgactgggactacgtggtgaccaccgacatcagcgagatgggcgccaacttccgggccgaccgcgtcatcgacccgcggcgctgcctgaagcccgtgatcctcaaggacgggcccgagcgggtgatcctggccggccccatgccggtcacggtggcctccgcggcccagcgccgggggcgcatcggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgcggccatcgacggggagtaccgcctccggggcgaggcccgcaagaccttcgtcgagctgatgcggcgcggggacctgcccgtgtggctctcctacaaggtggccagcgagggcttccagtacagcgaccggcgctggtgcttcgacggcgagcggaacaaccaggtcctggaggagaacatggacgtggagatctggacgaaggagggggagcgcaagaagctgcggccccgctggctcgacgcccggacctactccgaccccctggcgctgcgcgagttcaaggagttcgccgccggccggcgcagcgtgtccggggacctcatcctggagatcggcaagctgccgcagcacctcacccagcgggcccagaacgcgctggacaacctggtcatgctccacaacagcgagcagggcgggcgcgcctaccggcacgccatggaggagctgcccgacaccatcgagacgctgatgctcctggccctgatcgccgtgctcaccggcggggtgaccctgttcttcctgtccggccgcgggctcggcaagaccagcatcggcctgctgtgcgtcatggcgtccagcgtgctcctgtggatggcctccgtggagccccactggatcgccgccagcatcatcctggagttcttcctcatggtcctgctgatccccgagccggaccggcagcgcacgccccaggacaaccagctcgcctacgtggtgatcgggctgctgttcatgatcctcacggtcgcggccaacgagatgggcctgctggagaccaccaagaaggacctcgggatcggccacgtggccgtggagaaccacaaccacgccgccatgctggacgtcgacctgcaccccgcgtccgcctggaccctctacgccgtggccacgaccatcatcaccccgatgatgcggcacaccatcgagaacacgaccgccaacatcagcctgaccgcgatcgccaaccaggccgccatcctgatggggctcgacaagggctggcccatctccaagatggacatcggcgtgcccctgctggcgctcgggtgctacagccaggtcaaccccctgaccctgacggccgccgtgctcatgctggtggcccactacgccatcatcggcccggggctgcaggcgaaggccacccgcgaggcccagaagcgcaccgccgccggcatcatgaagaaccccaccgtcgacgggatcgtggcgatcgacctcgaccccgtggtctacgacgccaagttcgagaagcagctgggccagatcatgctgctcatcctgtgcacgtcccagatcctgctcatgcggaccacctgggccctgtgcgagagcatcaccctggccacgggccccctcaccaccctgtgggaggggtccccgggcaagttctggaacaccacgatcgccgtgagcatggcgaacatcttccgcgggtcctacctggccggcgccggcctcgccttcagcctgatgaagtccctcgggggcgggcggcgcgggaccggggcgcagggcgagaccctcggcgagaagtggaagcggcagctgaaccagctgtccaagagcgagttcaacacctacaagcgctccgggatcatggaggtggaccggagcgaggccaaggagggcctcaagcgcggggagacgaccaagcacgccgtctcccggggcaccgccaagctgcgctggttcgtggagcggaacctggtgaagcccgaggggaaggtcatcgacctgggctgcggccgcgggggctggagctactactgcgccgggctcaagaaggtgaccgaggtgaagggctacacgaagggcgggcccggccacgaggagcccatcccgatggcgacctacgggtggaacctggtcaagctgcactccggcaaggacgtgttcttcatcccgcccgagaagtgcgacaccctcctgtgcgacatcggggagagctcccccaacccgaccatcgaggagggccggacgctgcgcgtgctcaagatggtcgagccctggctgcgggggaaccagttctgcatcaagatcctgaacccctacatgcccagcgtggtggagaccctcgagcagatgcagcgcaagcacggcggcatgctggtccggaacccgctgtcccgcaacagcacccacgagatgtactgggtgtcctgcgggaccggcaacatcgtgagcgccgtcaacatgacctcccggatgctcctgaaccgcttcacgatggcccaccgcaagcccacctacgagcgggacgtggacctggggaccggcacccgccacgtggccgtcgagcccgaggtggccaacctcgacatcatcggccagcggatcgagaacatcaagcacgagcacaagagcacgtggcactacgacgaggacaacccctacaagacctgggcgtaccacgggtcctacgaggtgaagccgagcggctccgccagcagcatggtcaacggggtggtcaagctgctgaccaagccctgggacgtgatccccatggtgacccagatcgccatgacggacaccacccccttcggccagcagcgcgtcttcaaggagaaggtggacacccggacgccgaaggccaagcgcgggaccgcccagatcatggaggtgaccgcgcggtggctctggggcttcctgtcccgcaacaagaagccccggatctgcacccgcgaggagttcacgcggaaggtccgcagcaacgccgccatcggcgccgtgttcgtggacgagaaccagtggaactccgcgaaggaggccgtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtcgagggcgaggggctccacaagctgggctacatcctgcgcgacatcagcaagatccccgggggcaacatgtacgccgacgacaccgccggctgggacacccggatcacggaggacgacctccagaacgaggccaagatcaccgacatcatggagccggagcacgcgctgctggccaaggccatcttcaagctcacctaccagaacaaggtggtgcgcgtccagcgccccgccaagaacgggaccgtgatggacgtgatctcccggcgcgaccagcggggcagcgggcaggtcggcacgtacggcctgaacaccttcaccaacatggaggcccagctgatccgccagatggagtccgaggggatcttcagcccctccgagctcgagacccccaacctggcggagcgggccctggactggctcgagaagtacggcgtggagcgcctgaagcggatggccatcagcggggacgactgcgtggtcaagccgatcgacgaccgcttcgccacggccctgaccgcgctcaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctggtgggccgcgcccgggtctcccagggggccggctggagcctccgcgagaccgcctgcctgggcaagagctacgcgcagatgtggcagctgatgtacttccaccggcgcgacctccggctggccgccaacgccatctgctccgccgtgcccgtggactgggtccccaccagccgcacgacctggtccatccacgcgcaccaccagtggatgaccaccgaggacatgctgagcgtgtggaaccgggtgtggatcgaggagaacccctggatggaggacaagacgcacatctccagctgggaggacgtcccgtacctcggcaagcgcgaggaccagtggtgcgggtccctgatcggcctgaccgcccgcgccacctgggccaccaacatccaggtggccatcaaccaggtgcggcgcctcatcggcaacgagaactacctggactacatgaccagcatgaagcggttcaagaacgagtccgaccccgagggggcgctgtggtga

SEQ ID NO: 8023 - RNA, 9879 nt, synthetic construct
  misc_feature 1..9879: note = derived and/or modified CDS sequence (opt1) from DENV-1__FJ639682__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaagaccctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagctcacggtggtggtcggggacgtggccggcatcctggcgcaggggaagaagatgatccggccccagcccatggagtacaagtacagctggaagtcctggggcaaggccaagatcatcggcgccgacgcccagaacaccaccttcatcatcgacgggcccaacaccccggagtgccccgacgaccagcgcgcgtggaacatctgggaggtggaggactacggcttcgggatcttcacgaccaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgcgaacgccagcgaccgcatggggatgggcaccacctacctggccctcatggccacgttcaagatgcggccgatgttcgccgtcgggctgctgttccgccggctcacctcccgcgaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcctggaagacgatggcgatggtgctcagcatcgtctccctgttccccctgtgcctcagcaccacctcccagaagaccacgtggctgcccgtgctgctcggcagcctggggtgcaagccgctgaccatgttcctcatcgccgagaacaagatctggggccggaagtcctggcccctgaacgaggggatcatggccgtgggcatcgtcagcatcctgctcagctccctgctgaagaacgacgtgcccctcgccgggcccctgatcgccggcggcatgctgatcgcgtgctacgtgctcagcgggtccagcgccgacctgtccctggagaaggccgccgaggtcagctgggaggaggaggccgagcactccggcgcgagccacaacatcctcgtggaggtgcaggacgacgggaccatgaagatcaaggacgaggagcgcgacgacaccctgaccatcctgctcaaggccacgctgctggccgtctccggcgtgtacccgctcagcatccccgccaccctgttcgtgtggtacttctggcagaagaagaagcagcggtccggggtcctgtgggacacccccagcccgcccgaggtggagcgcgccgtgctggacgacggcatctaccggatcatgcagcgcggcctcctggggcggtcccaggtcggcgtgggggtgttccaggagaacgtcttccacaccatgtggcacgtgacgcgcggcgcggtgctgatgtaccaggggaagcggctcgagcccagctgggcctccgtcaagaaggacctgatcagctacggcggcgggtggcgcctgcagggctcctggaacaccggggaggaggtccaggtgatcgccgtcgagcccggcaagaaccccaagaacgtgcagaccgcccccgggaccttcaagacgcccgagggcgaggtgggcgccatcgcgctcgacttcaagcccgggaccagcggctcccccatcgtcaaccgggaggggaagatcgtgggcctgtacggcaacggggtggtcaccaccagcggcacgtacgtgagcgccatcgcccaggccaaggcgtcccaggaggggccgctgcccgagatcgaggacgaggtgttccgcaagcggaacctcaccatcatggacctgcaccccggcagcgggaagacccgccggtacctgccggccatcgtccgcgaggccatcaagcggaagctccgcaccctgatcctggcccccacgcgcgtggtggcctccgagatggcggaggccctcaagggcatccccatccggtaccagaccaccgccgtcaagagcgagcacaccggcaaggagatcgtggacctgatgtgccacgccacgttcaccatgcgcctgctctcccccgtgcgggtcccgaactacaacatgatcatcatggacgaggcccacttcaccgaccccagctccatcgcggcccgcgggtacatcagcacccgggtgggcatgggggaggccgccgccatcttcatgacggcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctgtcccgcaagacgttcgacaccgagtaccagaagaccaagaacaacgactgggactacgtggtgaccacggacatcagcgagatgggcgcgaacttccgggccgaccgcgtcatcgacccgcggcgctgcctcaagcccgtgatcctgaaggacgggcccgagcgggtgatcctggccggccccatgccggtcaccgtggcctccgccgcgcagcgccgggggcgcatcggccggaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgccgcgatcgacggggagtaccgcctgcggggcgaggcccgcaagacgttcgtcgagctgatgcggcgcggggacctccccgtgtggctgtcctacaaggtggccagcgagggcttccagtacagcgaccggcgctggtgcttcgacggcgagcggaacaaccaggtcctggaggagaacatggacgtggagatctggaccaaggagggggagcgcaagaagctccggccccgctggctggacgcccggacctactccgaccccctggccctccgcgagttcaaggagttcgcggccggccggcgcagcgtgtccggggacctgatcctggagatcggcaagctcccgcagcacctgacccagcgggcccagaacgccctggacaacctcgtcatgctgcacaacagcgagcagggcgggcgcgcgtaccggcacgccatggaggagctgcccgacacgatcgagaccctcatgctgctggccctcatcgccgtgctgaccggcggggtgaccctgttcttcctctccggccgcgggctgggcaagaccagcatcggcctgctctgcgtcatggcctccagcgtgctgctgtggatggcgtccgtggagccccactggatcgccgccagcatcatcctcgagttcttcctgatggtcctgctcatccccgagccggaccggcagcgcacgccccaggacaaccagctggcctacgtggtgatcgggctcctcttcatgatcctgaccgtcgccgcgaacgagatgggcctgctcgagaccaccaagaaggacctggggatcggccacgtggccgtggagaaccaccaccacgccgccatgctggacgtcgacctccaccccgcctccgcgtggacgctgtacgccgtggccaccaccatcatcaccccgatgatgcggcacacgatcgagaacaccaccgccaacatcagcctgaccgccatcgcgaaccaggccgccatcctcatggggctggacaagggctggcccatctccaagatggacatcggcgtgcccctgctcgccctggggtgctacagccaggtcaaccccctgacgctcaccgcggccgtgctgatgctggtggcccactacgccatcatcggcccggggctccaggccaaggcgacccgcgaggcccagaagcgcaccgccgccggcatcatgaagaaccccacggtcgacgggatcgtggccatcgacctggaccccgtggtctacgacgcgaagttcgagaagcagctgggccagatcatgctcctgatcctgtgcacctcccagatcctcctgatgcggaccacctgggccctgtgcgagagcatcacgctcgccaccggccccctgaccaccctgtgggaggggtccccgggcaagttctggaacacgaccatcgccgtgagcatggccaacatcttccgcgggtcctacctcgcgggcgccggcctggccttcagcctgatgaagtccctcgggggcgggcggcgcggcaccggggcccagggcgagaccctgggcgagaagtggaagcggcagctgaaccagctctccaagagcgagttcaacacgtacaagcgctccgggatcatggaggtggaccggagcgaggcgaaggagggcctgaagcgcggggagaccaccaagcacgccgtctcccggggcaccgccaagctgcgctggttcgtggagcggaacctggtgaagcccgaggggaaggtcatcgacctcggctgcggccgcgggggctggagctactactgcgccgggctgaagaaggtgacggaggtgaagggctacaccaagggcgggcccggccacgaggagcccatcccgatggccacctacgggtggaacctggtcaagctccactccggcaaggacgtgttcttcatcccgcccgagaagtgcgacaccctgctgtgcgacatcggggagagctcccccaacccgacgatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggaccggcaacatcgtgagcgcggtcaacatgacgtcccggatgctgctgaaccgcttcaccatggcccaccgcaagcccacctacgagcgggacgtggacctcgggaccggcacgcgccacgtggccgtcgagcccgaggtggccaacctggacatcatcggccagcggatcgagaacatcaagcacgagcacaagagcacctggcactacgacgaggacaacccctacaagacctgggcctaccacgggtcctacgaggtgaagccgagcggctccgcgagcagcatggtcaacggggtggtcaagctgctcaccaagccctgggacgtgatccccatggtgacgcagatcgccatgaccgacaccacccccttcggccagcagcgcgtcttcaaggagaaggtggacacgcggaccccgaaggccaagcgcgggaccgcccagatcatggaggtgaccgcccggtggctgtggggcttcctgtcccgcaacaagaagccccggatctgcacgcgcgaggagttcacccggaaggtccgcagcaacgcggccatcggcgccgtgttcgtggacgagaaccagtggaactccgccaaggaggcggtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtcgagggcgaggggctgcacaagctgggctacatcctccgcgacatcagcaagatccccgggggcaacatgtacgccgacgacaccgccggctgggacacgcggatcaccgaggacgacctgcagaacgaggccaagatcaccgacatcatggagccggagcacgccctgctcgcgaaggccatcttcaagctgacctaccagaacaaggtggtgcgcgtccagcgccccgccaagaacgggacggtgatggacgtgatctcccggcgcgaccagcggggcagcgggcaggtcggcacctacggcctgaacaccttcaccaacatggaggcccagctcatccgccagatggagtccgaggggatcttcagcccctccgagctggagacgcccaacctggccgagcgggcgctcgactggctggagaagtacggcgtggagcgcctgaagcggatggccatcagcggggacgactgcgtggtcaagccgatcgacgaccgcttcgccaccgccctcaccgccctgaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctcgtgggccgcgcgcgggtctcccagggggccggctggagcctgcgcgagaccgcctgcctgggcaagagctacgcccagatgtggcagctcatgtacttccaccggcgcgacctgcggctggcggccaacgccatctgctccgccgtgcccgtggactgggtccccacgagccgcaccacctggtccatccacgcccaccaccagtggatgaccacggaggacatgctcagcgtgtggaaccgggtgtggatcgaggagaacccctggatggaggacaagacccacatctccagctgggaggacgtcccgtacctgggcaagcgcgaggaccagtggtgcgggtccctgatcggcctcaccgcgcgcgccacctgggccaccaacatccaggtggccatcaaccaggtgcggcgcctgatcggcaacgagaactacctggactacatgacgagcatgaagcggttcaagaacgagtccgaccccgagggggccctctggtga

SEQ ID NO: 8024 - RNA, 9879 nt, synthetic construct
  misc_feature 1..9879: note = derived and/or modified CDS sequence (opt1) from DENV-1__JQ287664__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccggatcaccgaggtggagcccgacgacgtggactgctggtgcaacaccacggacacctgggtgacctacgggacctgcagccagacgggcgagcaccggcgcgacaagcggtccgtggccctcgcgccccacgtcggcctggggctggagacccgcgccgagacctggatgagctccgagggcgcgtggaagcagatccagcgggtggagacctgggccctccgccaccccgggttcacggtgatcgccctgttcctggcccacgtcatcggcaccagcatcacccagaaggggatcatcttcatcctcctgatgctggtgaccccctccatggcgatgcggtgcgtgggcatcggcagccgcgacttcgtcgaggggctctccggcgccacgtgggtggacgtggtcctggagcacgggagctgcgtgaccaccatggccaaggacaagcccaccctggacatcgagctcctgaagacggaggtgaccaaccccgccgtcctgcggaagctctgcatcgaggccaagatctccaacaccaccacggacagccgctgcccgacccagggcgaggcgaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtccacaccggcgaccagcaccaggtggggaacgagtccacggagcacggcaccaccgccaccatcacgccccaggcccccacgagcgagatccagctcaccgactacggggcgctgaccctggactgcagcccccggaccggcctcgacttcaacgagatggtgctgctgacgatgaaggagaagtcctggctcgtccacaagcagtggttcctggacctgcccctcccctggaccagcggggcctccaccagccaggagacctggaaccggcaggacctgctggtgacgttcaagaccgcccacgccaagaagcaggaggtggtcgtgctcggctcccaggagggcgccatgcacaccgcgctgaccggggccacggagatccagaccagcggcaccaccacgatcttcgccgggcacctgaagtgccgcctcaagatggacaagctgaccctgaagggcatgtcctacgtgatgtgcaccgggagcttcaagctcgagaaggaggtcgccgagacccagcacggcacggtgctggtgcagatcaagtacgagggcaccgacgccccctgcaagatccccttctccacccaggacgagaagggggtcacccagaacggccggctgatcacggcgaacccgatcgtgaccgacaaggagaagcccgtgaacatcgaggccgagccgcccttcggggagagctacatcgtcatcggcgccggcgagaaggccctgaagctctcctggttcaagaaggggagctccatcggcaagatgttcgaggcgaccgcccgcggggcccggcgcatggccatcctgggcgacaccgcctgggacttcgggagcatcggcggcgtgttcacgtccgtggggaagctggtccaccagatcttcggcaccgcgtacggggtgctgttcagcggcgtgtcctggaccatgaagatcgggatcggcgtcctgctgacctggctcggcctgaacagccgctccacgagcctgtccatgacctgcatcgccgtggggctcgtgaccctgtacctgggcgtcatggtgcaggccgacagcgggtgcgtgatcaactggaagggccgggagctcaagtgcgggagcggcatcttcgtcaccaacgaggtgcacacgtggaccgagcagtacaagttccaggccgactccccgaagcgcctgagcgccgcgatcggcaaggcctgggaggagggggtgtgcggcatccggtccgccacccgcctggagaacatcatgtggcggcagatcagcaacgagctcaaccacatcctgctggagaacgacatgaagttcaccgtcgtggtgggggacgtcgtgggcatcctcgcccaggggaagaagatgatccgcccccagcccatggagcacaagtactcctggaagtcctggggcaaggccaagatcatcggcgcggacgtgcagaacaccacgttcatcatcgacgggcccaacaccccggagtgccccgacgaccagcgggcctggaacatctgggaggtcgaggactacggcttcgggatcttcaccaccaacatctggctgaagctgcgcgactcctacacccaggtgtgcgaccaccggctcatgagcgccgccatcaaggactccaaggcggtgcacgccgacatgggctactggatcgagagcgagaagaacgagacctggaagctggcccgcgcctccttcatcgaggtcaagacctgcatctggcccaagagccacaccctgtggtccaacggcgtgctcgagagcgagatgatcatccccaagatctacgggggcccgatctcccagcacaactaccggcccgggtacttcacgcagaccgccggcccctggcacctggggaagctggagctcgacttcgacctgtgcgagggcaccaccgtggtcgtggacgagcactgcggcaaccgcgggccgagcctgcggacgaccaccgtgaccggcaagatcatccacgagtggtgctgccgctcctgcacgctgccgcccctccggttcaagggggaggacggctgctggtacgggatggagatccgccccgtcaaggagaaggaggagaacctggtcaagagcatggtgagcgcgggctccggcgaggtcgacagcttctccctcgggctgctgtgcatcagcatcatgatcgaggaggtgatgcggtcccgctggagccggaagatgctcatgaccggcaccctggccgtgttcttcctgctcatcatggggcagctgacctggaacgacctgatccgcctctgcatcatggtcggcgccaacgcctccgaccgcatggggatgggcacgacctacctggccctgatggcgaccttcaagatgcggccgatgttcgccgtgggcctcctgttccgccggctgaccagccgcgaggtcctcctgctgacgatcgggctctccctggtggccagcgtggagctgcccaactccctcgaggagctgggcgacgggctggccatgggcatcatgatcctcaagctgctgaccgacttccagagctaccagctctgggccaccctgctgtccctcaccttcatcaagacgaccttcagcctgcactacgcgtggaagaccatggccatggtcctgtccatcgtgagcctcctgcccctgtgcctctccaccacgagccagaagaccacctggctgcccgtgctgctcggctccctggggtgcaagccgctgaccatgttcttcatcgccgagaacaagatctggggccgcaagagctggcccctcaacgaggggatcatggccgtcggcatcgtgagcatcctgctgtccagcctcctgaagaacgacgtgcccctggcggggcccctcatcgccggcggcatgctgatcgcctgctacgtcatctccgggagctccgccgacctgagcctcgagaaggccgcggaggtgtcctgggaggaggaggccgagcacagcggcgcctcccacaacatcctggtggaggtccaggacgacgggacgatgaagatcaaggacgaggagcgcgacgacaccctgaccatcctcctgaaggccaccctgctcgccgtgagcggcgtgtacccgctgtccatccccgcgaccctgttcgtctggtacttctggcagaagaagaagcagcggagcggggtgctctgggacacgcccagcccgcccgaggtggagcgcgccgtcctggacgacggcatctaccggatcatgcagcgcggcctgctggggcggagccaggtgggcgtgggggtcttccaggagaacgtgttccacaccatgtggcacgtgacccgcggcgccgtcctcatgtaccaggggaagcggctggagccctcctgggccagcgtgaagaaggacctgatctcctacggcggcgggtggcgcctccagggcagctggaacaccggggaggaggtgcaggtcatcgccgtggagcccggcaagaaccccaagaacgtgcagacggcgcccgggaccttcaagacccccgagggcgaggtcggcgccatcgccctggacttcaagcccgggacctccggcagccccatcgtgaaccgggaggggaagatcgtgggcctgtacggcaacggggtcgtgacgaccagcggcacctacgtgtccgccatcgcccaggcgaaggccagccaggaggggccgctccccgagatcgaggacgaggtcttccgcaagcggaacctgaccatcatggacctgcaccccggctccgggaagacgcgcaagtacctcccggccatcgtgcgggaggccatcaagcgcaagctgcggaccctgatcctcgcgcccacccgcgtggtcgccagcgagatggccgaggccctgaagggcatgcccatccgctaccagaccacggccgtgaagtccgagcacaccggccgggagatcgtggacctgatgtgccacgcgaccttcaccatgcgcctcctgagccccgtccgggtgccgaactacaacatgatcatcatggacgaggcccacttcacggacccctccagcatcgccgcccgcgggtacatctccacccgggtgggcatgggggaggccgcggccatcttcatgaccgccacgccgcccggcagcgtcgaggccttcccgcagtccaacgccgtgatccaggacgaggagcgcgacatccccgagcggagctggaactccgggtacgagtggatcacggacttccccggcaagaccgtgtggttcgtccccagcatcaagtccggcaacgacatcgcgaactgcctgcgcaagaacgggaagcgggtgatccagctcagccgcaagaccttcgacaccgagtaccagaagacgaagaacaacgactgggactacgtggtcaccaccgacatctccgagatgggcgccaacttccgggccgaccgcgtgatcgacccgcggcgctgcctgaagcccgtcatcctgaaggacgggcccgagcgggtgatcctcgccggccccatgccggtgaccgtcgcgagcgccgcccagcgccgggggcgcatcggccggaaccacaacaaggagggcgaccagtacatctacatggggcagcccctgaacaacgacgaggaccacgcccactggacggaggccaagatgctgctcgacaacatcaacacccccgagggcatcatccccgcgctgttcgagccggagcgcgagaagtccgccgccatcgacggggagtaccgcctgcggggcgaggcccgcaagaccttcgtggagctcatgcggcgcggggacctgcccgtgtggctgagctacaaggtcgccagcgagggcttccagtactccgaccggcgctggtgcttcgacggcgagcggaacaaccaggtgctcgaggagaacatggacgtggagatctggaccaaggagggggagcgcaagaagctgcggccccgctggctggacgcgcggacgtacagcgaccccctcgccctgcgcgagttcaaggagttcgccgccggccggcgctccatcagcggggacctgatcctcgagatcggcaagctgccgcagcacctgacccagcgggcccagaacgcgctcgacaacctggtcatgctgcacaactccgagcagggcgggcgcgcctaccggcacgccatggaggagctccccgacaccatcgagaccctgatgctgctcgccctgatcgcggtgctgacgggcggggtgaccctcttcttcctgagcggccgcgggctgggcaagacctccatcggcctcctgtgcgtcatggccagctccgccctgctctggatggccagcgtggagccccactggatcgccgcgtccatcatcctggagttcttcctgatggtgctcctgatccccgagccggaccggcagcgcacgccccaggacaaccagctggcctacgtcgtgatcgggctcctgttcatgatcctgaccgtggccgccaacgagatgggcctcctggagacgaccaagaaggacctggggatcggccacgtcgccgtggagaaccaccaccacgcgaccatgctcgacgtggacctgcaccccgccagcgcctggaccctgtacgccgtcgccacgaccatcatcaccccgatgatgcggcacaccatcgagaacacgaccgcgaacatctccctcaccgccatcgccaaccaggccgccatcctgatggggctggacaagggctggcccatcagcaagatggacatcggcgtgcccctcctggcgctggggtgctactcccaggtgaaccccctcaccctgacggccgccgtcctgatgctcgtggcccactacgcgatcatcggcccggggctgcaggccaaggccacccgcgaggcccagaagcgcaccgccgcgggcatcatgaagaaccccaccgtggacgggatcgtcgccatcgacctggaccccgtggtgtacgacgccaagttcgagaagcagctcggccagatcatgctgctgatcctctgcacgagccagatcctgctgatgcggaccacctgggccctctgcgagtccatcaccctggccacgggccccctgaccaccctctgggaggggagcccgggcaagttctggaacaccacgatcgcggtctccatggccaacatcttccgcgggagctacctggccggcgccggcctggccttcagcctcatgaagtccctcgggggcgggcggcgcgggaccggggcgcagggcgagaccctgggcgagaagtggaagcggcagctcaaccagctgagcaagtccgagttcaacacctacaagcgcagcgggatcctggaggtggaccggtccgaggccaaggagggcctccgccgcggggagacgaccaagcacgccgtgagccgcggcaccgccaagctgcggtggttcgtcgagcgcaacctggtgaagcccgaggggaaggtgatcgacctgggctgcggccgcggcgggtggtcctactactgcgcggggctcaagaaggtcaccgaggtgaaggggtacacgaagggcgggcccggccacgaggagcccatcccgatggccacctacgggtggaacctggtgaagctgcacagcggcaaggacgtcttcttcatcccgcccgagaagtgcgacaccctcctgtgcgacatcggggagtccagccccaacccgaccatcgaggagggccgcacgctgcgggtgctcaagatggtggagccctggctgcgcgggaaccagttctgcatcaagatcctgaacccctacatgccctccgtcgtggagaccctcgagcagatgcagcggaagcacggcggcatgctggtgcgcaacccgctgagccggaactccacccacgagatgtactgggtcagctgcgggaccggcaacatcgtgtccgccgtgaacatgaccagccgcatgctcctgaaccgcttcacgatggcccaccggaagcccacctacgagcgcgacgtcgacctgggggccggcacccggcacgtggcggtggagcccgaggtcgccaacctcgacatcatcggccagcgcatcgagaacatcaagcacgagcacaagtccacctggcactacgacgaggacaacccctacaagacgtgggcctaccacgggagctacgaggtgaagccgtccggcagcgccagctccatggtcaacggggtggtgaagctgctgaccaagccctgggacgtcatccccatggtgacccagatcgccatgaccgacacgacccccttcggccagcagcgggtgttcaaggagaaggtcgacacccgcaccccgaaggcgaagcgggggacggcccagatcatggaggtgaccgcccgctggctctggggcttcctgagccggaacaagaagccccgcatctgcacccgggaggagttcacccgcaaggtgcggtccaacgccgccatcggcgcggtcttcgtggacgagaaccagtggaacagcgccaaggaggccgtggaggacgagcgcttctgggacctggtccaccgggagcgcgagctccacaagcaggggaagtgcgccacgtgcgtgtacaacatgatgggcaagcgggagaagaagctgggggagttcggcaaggcgaaggggtcccgcgccatctggtacatgtggctgggcgcccggttcctcgagttcgaggccctgggcttcatgaacgaggaccactggttcagccgcgagaactccctgagcggggtggagggcgaggggctccacaagctgggctacatcctgcgggacatctccaagatccccgggggcaacatgtacgccgacgacaccgcgggctgggacacccgcatcaccgaggacgacctccagaacgaggccaagatcacggacatcatggagccggagcacgccctgctggccaccagcatcttcaagctcacctaccagaacaaggtcgtgcgcgtgcagcggcccgccaagaacgggaccgtcatggacgtgatctcccgccgggaccagcgcggcagcggccaggtgggcacgtacggcctgaacaccttcaccaacatggaggcgcagctgatccggcagatggagtccgaggggatcttcagcccctccgagctcgagacccccaacctggccgagcgcgtcctggactggctcgagaagtacggcgtggagcggctgaagcgcatggccatcagcggggacgactgcgtggtcaagccgatcgacgaccggttcgccacggccctgaccgcgctcaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctggtgggccgggcccgcgtcagccagggggccggctggtccctccgggagaccgcctgcctgggcaagagctacgcccagatgtggcagctgatgtacttccaccgccgggacctccgcctggcggccaacgccatctgctccgccgtgcccttcgactgggtgcccaccagccggacgacctggtccatccacgcgcaccaccagtggatgaccaccgaggacatgctgagcgtctggaaccgcgtgtggatcgaggagaacccctggatggaggacaagacgcacatctccagctgggaggacgtgccgtacctcggcaagcgcgaggaccagtggtgcgggtccctgatcggcctgaccgcccgggccacctgggccaccaacatccaggtcgccatcaaccaggtgcgccggctcatcggcaacgagaactacctggactacatgaccagcatgaagcgcttcaagaacgagtccgacacggagggggcgctgtggtga

SEQ ID NO: 8025 - RNA, 9879 nt, synthetic construct
  misc_feature 1..9879: note = derived and/or modified CDS sequence (opt1) from DENV-1__FJ639683__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgccccacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccttcagcatgacctgcatcgccgtggggctggtgaccctctacctgggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctctccgccgccatcggcaaggcctgggaggagggggtgtgcggcatccggagcgccacccgcctggagaacatcatgtggaagcagatctccaacgagctgaaccacatcctcctggagaacgacatgaagttcaccgtcgtggtgggggacgtcgcgggcatcctggcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctcaagctgcgggacagctacacccaggtctgcgaccaccgcctgatgtccgccgccatcaaggacagcaaggccgtgcacgccgacatgggctactggatcgagtccgagaagaacgagacctggaagctcgcgcgggccagcttcatcgaggtgaagacctgcatctggcccaagtcccacacgctgtggagcaacggcgtcctggagtccgagatgatcatccccaagatctacgggggcccgatcagccagcacaactaccgccccgggtacttcacccagaccgccggcccctggcacctcgggaagctggagctggacttcgacctctgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccctggtgagcgccggcagcggcgaggtggactccttcagcctcgggctgctgtgcatctccatcatgatcgaggaggtcatgcggagccgctggtcccggaagatgctcatgaccggcaccctggccgtgttcctgctcctgatcatggggcagctgacgtggaacgacctcatccgcctgtgcatcatggtgggcgcgaacgccagcgaccgcatggggatgggcaccacctacctggccctcatggccaccttcaagatgcggccgatgttcgccgtcgggctgctgttccgccggctcacgtcccgcgaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcgtgctacgtgatcagcgggtccagcgccgacctctccctggagaaggccgccgaggtcagctgggaggaggaggccgagcactccggcgcgagccacaacatcctggtggaggtgcaggacgacgggaccatgaagatcaaggacgaggagcgggacgacaccctcaccatcctgctgaaggccaccctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacccggggcgcggtgctgatgtaccaggggaagcgcctggagcccagctgggcctccgtcaagaaggacctcatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgcgaggggaagatcgtgggcctctacggcaacggggtggtcaccaccagcggcacctacgtgagcgccatcgcccaggccaaggcgtcccaggaggggccgctgcccgagatcgaggacgaggtgttccggaagcgcaacctgacgatcatggacctccaccccggcagcgggaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggcacgagtggatcaccgacttccccggcaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctcaaggacgggcccgagcgcgtgatcctggccggccccatgccggtcacggtggcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggacgaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtcatgctccacaacagcgagcagggcgggcgggcgtaccgccacgccatggaggagctgcccgacaccatcgagacgctgatgctcctggccctgatcgccgtgctcaccggcggggtgaccctgttcttcctgtccggccgggggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccgccagcggacgccccaggacaaccagctcgcctacgtggtgatcgggctgctgttcatgatcctcacggtcgccgcgaacgagatgggcctgctggagaccaccaagaaggacctcgggatcggccacgtggccgtggggaaccaccaccacgccgccatgctggacgtcgacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtgcccctgctggccctcggctgctacagccaggtcaaccccctgaccctgacggcggccgtgctcatgctggtggcccactacgccatcatcgggccgggcctgcaggccaaggcgacccgcgaggcccagaagcggaccgccgccgggatcatgaagaaccccaccgtcgacggcatcgtggccatcgacctcgaccccgtggtctacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtggaccgcagcgaggcgaaggaggggctcaagcggggcgagacgaccaagcacgccgtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacacgaagggcggccccgggcacgaggagcccatcccgatggccacctacggctggaacctggtcaagctgcactccgggaaggacgtgttcttcgtgccgcccgagaagtgcgacaccctcctgtgcgacatcggcgagagctcccccaacccgaccatcgaggaggggcgcacgctgcgggtcctcaagatggtggagccctggctgcgcggcaaccagttctgcatcaagatcctgaacccctacatgcccagcgtggtcgagaccctcgagcagatgcagcggaagcacggcgggatgctggtgcgcaacccgctgtcccggaacagcacccacgagatgtactgggtgtcctgcggcaccgggaacatcgtcagcgcggtgaacatgacctcccgcatgctcctgaaccgcttcacgatggcccaccggaagcccacctacgagcgcgacgtggacctgggcgccggcacccggcacgtcgccgtggagcccgaggtggccaacctcgacatcatcgggcagcgcatcgagaacatcaagcacgagcacaagagcacctggcactacgacgaggacaacccctacaagacgtgggcgtaccacggctcctacgaggtcaagccgagcgggtccgccagcagcatggtgaacggcgtcgtgaagctgctgaccaagccctgggacgtgatccccatggtcacccagatcgccatgaccgacacgacccccttcgggcagcagcgggtgttcaaggagaaggtggacacccgcaccccgaaggccaagcggggcacggcccagatcatggaggtcaccgcgaagtggctctggggcttcctgtcccgcaacaagaagccccggatctgcacccgcgaggagttcacccggaaggtgcgcagcaacgccgccatcggggccgtgttcgtcgacgagaaccagtggaactccgcgaaggaggccgtggaggacgagcggttctgggacctggtgcaccgcgagcgggagctccacaagcagggcaagtgcgccacgtgcgtctacaacatgatggggaagcgcgagaagaagctgggcgagttcgggaaggccaagggcagccgggccatctggtacatgtggctgggcgcgcgcttcctcgagttcgaggccctggggttcatgaacgaggaccactggttctcccgggagaacagcctgtccggcgtggagggggagggcctccacaagctggggtacatcctgcgcgacatcagcaagatccccggcggcaacatgtacgccgacgacaccgccgggtgggacacccggatcaccgaggacgacctccagaacgaggcccgcatcacggacatcatggagccggagcacgcgctgctggccaagtccatcttcaagctcacctaccagaacaaggtggtccgcgtgcagcggcccgccaagaacggcaccgtgatggacgtcatcagccgccgggaccagcgcgggtccggccaggtgggcacctacgggctgaacacgttcaccaacatggaggcccagctgatccggcagatggagagcgagggcatcttctcccccagcgagctcgagacccccaacctggccgagcgcgtgctggactggctcgagaagtacggggtcgagcggctgaagcgcatggcgatctccggcgacgactgcgtggtgaagccgatcgacgaccggttcgccaccgccctgacggccctcaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctggtggggcgggcccgcgtgagccagggcgcggggtggagcctccgggagaccgcctgcctgggcaagtcctacgcccagatgtggcagctgatgtacttccaccgccgggacctccgcctggccgcgaacgccatctgcagcgccgtccccgtggactggatccccacctcccggaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctcggcaagcgcgaggaccagtggtgcggcagcctgatcgggctgacggcccgggcgacctgggccaccaacatccaggtggccatcaaccaggtccgccggctcatcggcaacgagaactacctggactacatgacctccatgaagcgcttcaagaacgagagcgaccccgagggggccctgtggtga

SEQ ID NO: 8026 - RNA, 9879 nt, synthetic construct
  misc_feature 1..9879: note = derived and/or modified CDS sequence (opt1) from DENV-1__FJ639684__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccggatcagcgaggccgagcccgacgacgtggactgctggtgcaacgccaccgacacctgggtgacctacgggacctgctcccagaccggcgagcaccggcgcgacaagcggagcgtggccctggcgccccacgtgggcctcgggctggagacccggacggagacctggatgtccagcgagggcgcctggaagcagatccagcgggtcgagacctgggccctgcgccaccccgggttcaccgtgatcgccctcttcctggcgcacgccatcggcacgtccatcacccagaaggggatcatcttcatcctgctcatgctggtgacccccagcatggccatgcggtgcgtcggcatcggctcccgcgacttcgtggaggggctgagcggcgccacctgggtggacgtcgtgctcgagcacgggtcctgcgtgacgaccatggccaaggacaagcccaccctggacatcgagctgctcaagaccgaggtcacgaaccccgcggtgctgcggaagctgtgcatcgaggccaagatcagcaacaccaccaccgactcccgctgcccgacgcagggcgaggccaccctcgtggaggagcaggacgccaacttcgtctgccggcgcaccttcgtggaccggggctgggggaacggctgcgggctgttcggcaaggggagcctgatcacgtgcgccaagttcaagtgcgtgacgaagctcgagggcaagatcgtccagtacgagaacctgaagtactccgtgatcgtgaccgtccacaccggcgaccagcaccaggtggggaacgagagcaccgagcacggcacgaccgcgaccatcacgccccaggccccctccaccgagatccagctgacggactacggggccctcaccctggactgcagcccccgcaccggcctggacttcaacgagatggtcctcctgaccatgaaggagaagtcctggctggtgcacaagcagtggttcctcgacctgccgctgccctggacgtccggggccagcacctcccaggagacctggaaccggcaggacctcctggtgaccttcaagacggcccacgcgaagaagcaggaggtcgtggtgctgggcagccaggagggcgccatgcacaccgccctcaccggggccaccgagatccagacgtccggcaccaccaccatcttcgccgggcacctgaagtgccgcctgaagatggacaagctcacgctgaagggcatgagctacgtcatgtgcaccgggtccttcaagctggagaaggaggtggcggagacccagcacggcaccgtgctcgtccagatcaagtacgagggcacggacgccccctgcaagatccccttcagcacccaggacgagaagggggtgacccagaacggccggctgatcaccgccaacccgatcgtgacggacaaggagaagcccgtcaacatcgaggccgagccgcccttcggggagtcctacatcgtgatcggcgcgggcgagaaggccctgaagctgagctggttcaagaaggggtccagcatcggcaagatgttcgaggccaccgcccgcggggcccggcgcatggcgatcctcggcgacaccgcctgggacttcgggtccatcggcggcgtgttcaccagcgtcgggaagctggtgcaccagatcttcggcacggcctacggggtgctgttctccggcgtcagctggaccatgaagatcgggatcggcgtgctcctgacctggctgggcctcaactcccgcagcacctccctgagcatgacgtgcatcgccgtggggctggtcaccctctacctgggcgtgatggtgcaggccgacagcgggtgcgtcatcaactggaagggccgggagctgaagtgcgggtccggcatcttcgtgaccaacgaggtgcacacctggacggagcagtacaagttccaggcggacagcccgaagcgcctctccgccgccatcggcaaggcctgggaggagggggtctgcggcatccggagcgccacccgcctggagaacatcatgtggaagcagatctccaacgagctgaaccacatcctcctggagaacgacatgaagttcaccgtggtggtcggggacgtggcgggcatcctggcccaggggaagaagatgatccggccccagcccatggagtacaagtacagctggaagtcctggggcaaggccaagatcatcggcgccgacgtgcagaacaccaccttcatcatcgacgggcccaacacgccggagtgccccgacgaccagcgcgcgtggaacatctgggaggtcgaggactacggcttcgggatcttcaccaccaacatctggctcaagctgcgggacagctacacccaggtgtgcgaccaccgcctgatgtccgccgccatcaaggacagcaaggccgtgcacgccgacatgggctactggatcgagtccgagaagaacgagacgtggaagctcgcgcgggccagcttcatcgaggtcaagacctgcatctggcccaagtcccacaccctgtggagcaacggcgtgctggagtccgagatgatcatccccaagatctacgggggcccgatcagccagcacaactaccgccccgggtacttcacccagacggccggcccctggcacctcgggaagctggagctggacttcgacctctgcgagggcaccaccgtggtcgtggacgagcactgcggcaaccgggggccgtccctgcgcaccacgaccgtgaccggcaagatcatccacgagtggtgctgccggagctgcaccctgccgcccctgcgcttcaagggggaggacggctgctggtacgggatggagatccggcccgtcaaggagaaggaggagaacctggtcaagagcatggtgtccgccggcagcggcgaggtcgactccttcagcctggggctcctgtgcatctccatcatgatcgaggaggtgatgcgcagccggtggtcccgcaagatgctgatgacgggcaccctcgccgtgttcttcctgctgatcatggggcagctcacctggaacgacctgatccggctgtgcatcatggtcggcgcgaacgccagcgaccgcatggggatgggcatgacctacctcgccctgatggccacgttcaagatgcgcccgatgttcgccgtgggcctcctgttccggcgcctgacctcccgggaggtgctgctcctgaccatcgggctgagcctcgtcgcgtccgtggagctgcccaacagcctggaggagctcggcgacgggctggccatgggcatcatgatcctgaagctcctgaccgacttccagtcccaccagctgtgggccacgctcctgagcctgaccttcatcaagaccaccttctccctccactacgcctggaagacgatggcgatggtcctgagcatcgtgtccctgttccccctctgcctgagcaccacctcccagaagaccacgtggctgcccgtgctcctgggcagcctggggtgcaagccgctcaccatgttcctgatcgccgagaacaagatctggggccgcaagagctggcccctgaacgaggggatcatggccgtcggcatcgtgtccatcctcctgagctccctgctcaagaacgacgtgcccctggccgggcccctgatcgccggcggcatgctcatcgcgtgctacgtcatcagcgggtccagcgccgacctgtccctggagaaggccgccgaggtgagctgggaggaggaggccgagcactccggcgcgagccacaacatcctcgtggaggtccaggacgacgggaccatgaagatcaaggacgaggagcgggacgacaccctgacgatcctgctcaaggccaccctgctggccgtgtccggcgtgtacccgctcagcatccccgccaccctgttcgtctggtacttctggcagaagaagaagcagcgctccggggtgctgtgggacacccccagcccgcccgaggtggagcgggccgtcctcgacgacggcatctaccgcatcatgcagcggggcctgctggggcgctcccaggtgggcgtgggggtcttccaggagaacgtgttccacaccatgtggcacgtgacgcggggcgcggtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagaccgcccccgggaccttcaagacgagcgagggcgaggtcggcgccatcgcgctcgacttcaagcccgggaccagcggctcccccatcgtgaaccgcgaggggaagatcgtgggcctgtacggcaacggggtcgtgaccaccagcggcacgtacgtgtccgccatcgcccaggccaaggcgagccaggaggggcccctgccggagatcgaggacgaggtcttccggaagcgcaacctcaccatcatggacctgcaccccggctccgggaagacccggcgctacctgcccgccatcgtgcgggaggccatcaagcgcaagctccggaccctgatcctggccccgacgcgcgtggtcgccagcgagatggcggaggccctcaagggcatgcccatccgctaccagaccaccgccgtgaagtccgagcacaccggcaaggagatcgtggacctgatgtgccacgccacgttcaccatgcggctgctcagccccgtccgcgtgcccaactacaacatgatcatcatggacgaggcccacttcaccgacccgtccagcatcgcggcccgggggtacatctccacccgcgtgggcatgggggaggccgccgccatcttcatgacggcgacgccgcccggcagcgtcgaggccttcccccagtccaacgccgtgatccaggacgaggagcgggacatcccggagcgcagctggaactccgggtacgagtggatcaccgacttccccggcaagaccgtgtggttcgtccccagcatcaagtccggcaacgacatcgccaactgcctgcggaagaacgggaagcgcgtgatccagctgagccggaagacgttcgacaccgagtaccagaagaccaagaacaacgactgggactacgtggtcaccacggacatctccgagatgggcgcgaacttccgcgccgaccgggtgatcgacccccgccggtgcctcaagccggtgatcctgaaggacgggcccgagcgcgtcatcctggccggccccatgcccgtgaccgtcgccagcgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagacgttcgtggagctgatgcgccgcggggacctcccggtgtggctgtcctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcccgcacctacagcgaccccctggccctccgggagttcaaggagttcgcggccggccgccggtccgtcagcggggacctgatcctggagatcggcaagctcccccagcacctgacccagcgcgcccagaacgccctggacaacctcgtgatgctgcacaactccgagcagggcgggcgggcgtaccgccacgccatggaggagctgccggacacgatcgagaccctcatgctgctggccctcatcgccgtgctgaccggcggggtcaccctgttcttcctcagcggccgggggctgggcaagacgtccatcggcctgctctgcgtgatggccagctccgtgctgctgtggatggcgagcgtcgagccccactggatcgccgcctccatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagaccaccaagaaggacctggggatcggccacgtggccgtcgagaaccaccaccacgccgccatgctggacgtggacctccaccccgccagcgcgtggacgctgtacgccgtggccaccaccatcatcacccccatgatgcgccacacgatcgagaacaccaccgccaacatctccctgaccgccatcgcgaaccaggccgccatcctcatggggctggacaagggctggccgatcagcaagatggacatcggcgtccccctgctcgccctggggtgctactcccaggtgaaccccctgacgctcaccgcggccgtgctgatgctggtcgcccactacgccatcatcggccccgggctccaggccaaggcgacccgggaggcccagaagcgcaccgccgccggcatcatgaagaacccgacggtggacgggatcgtggccatcgacctggaccccgtcgtgtacgacgcgaagttcgagaagcagctgggccagatcatgctcctgatcctgtgcaccagccagatcctcctgatgcgcaccacctgggccctgtgcgagtccatcacgctcgccaccggccccctgaccaccctgtgggaggggagccccggcaagttctggaacacgaccatcgccgtgagcatggccaacatcttccgggggtcctacctcgcgggcgccggcctggccttcagcctgatgaagtccctcgggggcgggcgccggggcaccggggcccagggcgagaccctgggcgagaagtggaagcgccagctgaaccagctcagcaagtccgagttcaacacgtacaagcggagcgggatcatggaggtcgaccgctccgaggcgaaggagggcctgaagcgcggggagaccaccaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgacggaggtcaaggggtacaccaagggcgggcccggccacgaggagcccatccccatggccacctacgggtggaacctggtgaagctccacagcggcaaggacgtgttcttcgtcccgcccgagaagtgcgacaccctgctgtgcgacatcggggagtccagccccaaccccacgatcgaggagggccgcaccctccgggtgctgaagatggtggagccgtggctgcgcgggaaccagttctgcatcaagatcctcaacccctacatgccctccgtcgtggagaccctggagcagatgcagcggaagcacggcggcatgctggtgcgcaaccccctcagccggaactccacccacgagatgtactgggtcagctgcgggacgggcaacatcgtgtccgcggtgaacatgaccagccgcatgctgctgaaccggttcaccatggcccaccgcaagccgacctacgagcgcgacgtcgacctcggggccggcacccggcacgtggccgtggagcccgaggtcgccaacctggacatcatcggccagcgcatcgagaacatcaagcacgagcacaagtccacgtggcactacgacgaggacaacccctacaagacctgggcgtaccacgggagctacgaggtgaagcccagcggctccgccagctccatggtcaacggggtggtgaagctgctcaccaagccgtgggacgtcatccccatggtgacccagatcgccatgacggacaccacccccttcggccagcagcgggtgttcaaggagaaggtcgacacccgcacgcccaaggccaagcgggggaccgcccagatcatggaggtgaccgcgaagtggctgtggggcttcctgagccgcaacaagaagccgcggatctgcacccgcgaggagttcacgcggaaggtgcgctccaacgccgccatcggcgccgtcttcgtggacgagaaccagtggaacagcgcgaaggaggccgtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggtcccgggccatctggtacatgtggctcggcgcgcgcttcctggagttcgaggccctgggcttcatgaacgaggaccactggttcagccgggagaactccctcagcggggtggagggcgaggggctgcacaagctgggctacatcctccgcgacatctccaagatcagcgggggcaacatgtacgccgacgacaccgccggctgggacacccggatcacggaggacgacctgcagaacgaggccaagatcaccgacatcatggagcccgagcacgcgctgctcgccaagtccatcttcaagctgacctaccagaacaaggtcgtgcgcgtgcagcggcccgccaagaacgggaccgtcatggacgtgatcagccgccgcgaccagcggggctccggccaggtgggcacgtacggcctgaacaccttcaccaacatggaggcccagctcatccgccagatggagagcgaggggatcttctccccgagcgagctggagacccccaacctggccgagcgggcgctcgactggctggagaagcacggcgtcgagcgcctgaagcggatggccatcagcggggacgactgcgtggtgaagcccatcgacgaccgcttcgccacggccctcaccgccctgaacgacatgggcaaggtccggaaggacatcccccagtgggagccgtccaaggggtggaacgactggcagcaggtccccttctgcagccaccacttccaccagctgatcatgaaggacggccgcgagatcgtggtcccctgccggaaccaggacgagctcgtgggccgcgcgcgggtgtcccagggggccggctggagcctgcgcgagaccgcctgcctggggaagtcctacgcccagatgtggcagctcatgtacttccaccggcgcgacctgcggctggcggccaacgccatctgcagcgccgtccccgtggactgggtgccgacctcccgcacgacctggagcatccacgcccaccaccagtggatgaccaccgaggacatgctctccgtctggaaccgggtgtggatcgaggagaacccctggatggaggacaagacgcacatcagctcctgggaggacgtgccctacctgggcaagcgcgaggaccagtggtgcgggagcctgatcggcctcaccgcgcgggccacctgggccaccaacatccaggtcgccatcaaccaggtgcgccgcctgatcggcaacgagaactacctggactacatgacgtccatgaagcggttcaagaacgagagcgtgcccgagggggccctctggtga

SEQ ID NO: 8027 - RNA, 9879 nt, synthetic construct
  misc_feature 1..9879: note = derived and/or modified CDS sequence (opt1) from DENV-1__FJ639685__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgccccacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccttcagcatgacctgcatcgccgtggggctggtgaccctctacctgggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctctccgccgccatcggcaaggcctgggaggagggggtgtgcggcatccggagcgccacccgcctggagaacatcatgtggaagcagatctccaacgagctgaaccacatcctcctggagaacgacatgaagttcaccgtcgtggtgggggacgtcgcgggcatcctggcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctcaagctgcgggacagctacacccaggtctgcgaccaccgcctgatgtccgccgccatcaaggacagcaaggccgtgcacgccgacatgggctactggatcgagtccgagaagaacgagacctggaagctcgcgcgggccagcttcatcgaggtgaagacctgcatctggcccaagtcccacacgctgtggagcaacggcgtcctggagtccgagatgatcatccccaagatctacgggggcccgatcagccagcacaactaccgccccgggtacttcacccagaccgccggcccctggcacctcgggaagctggagctggacttcgacctctgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctggggctcctgtgcatctccatcatgatcgaggaggtcatgcggagccgctggtcccggaagatgctgatgaccggcaccctcgccgtgttcctgctgctcatcatggggcagctgacgtggaacgacctgatccgcctctgcatcatggtgggcgcgaacgccagcgaccgcatggggatgggcaccacctacctggccctgatggccaccttcaagatgcggccgatgttcgccgtcgggctcctgttccgccggctgacgtcccgcgaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtgctgagcatcgtctccctcttccccctgtgcctgagcacgacctcccagaagaccacctggctccccgtgctgctgggcagcctcgggtgcaagccgctgacgatgttcctgatcgccgagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgggacgacaccctgaccatcctcctgaaggccaccctgctcgccgtctccggcgtgtacccgctgagcatccccgccacgctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacccggggcgcggtgctcatgtaccaggggaagcgcctggagcccagctgggcctccgtcaagaaggacctgatcagctacggcggcgggtggcggctccagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgcgaggggaagatcgtgggcctgtacggcaacggggtggtcaccaccagcggcacctacgtgagcgccatcgcccaggccaaggcgtcccaggaggggccgctccccgagatcgaggacgaggtgttccggaagcgcaacctgacgatcatggacctgcaccccggcagcgggaagacccggcgctacctcccggccatcgtccgggaggccatcaagcgcaagctgcgcaccctgatcctcgcccccacccgggtggtggcctccgagatggcggaggccctgaagggcatgcccatccgctaccagacgaccgccgtcaagagcgagcacaccggcaaggagatcgtggacctgatgtgccacgccaccttcacgatgcggctcctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctgaaggacgggcccgagcgcgtgatcctcgccggccccatgccggtcacggtggcctccgccgcgcagcggcgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccggctgcgcggcgaggcccggaagaccttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggacgaaggagggggagcggaagaagctgcgcccccggtggctggacgcccgcacctactccgaccccctcgccctgcgggagttcaaggagttcgcggccggccgccggagcgtgtccggggacctgatcctcgagatcggcaagctgccgcagcacctgacccagcgcgcccagaacgccctcgacaacctggtcatgctgcacaacagcgagcagggcgggcgggcgtaccgccacgccatggaggagctccccgacaccatcgagacgctgatgctgctcgccctgatcgccgtgctgaccggcggggtgaccctcttcttcctgtccggccgggggctgggcaagaccagcatcggcctcctgtgcgtcatggcctccagcgtgctgctctggatggcgtccgtggagccccactggatcgccgccagcatcatcctggagttcttcctgatggtcctcctgatccccgagccggaccgccagcggacgccccaggacaaccagctggcctacgtggtgatcgggctcctgttcatgatcctgacggtcgccgcgaacgagatgggcctcctggagaccaccaagaaggacctggggatcggccacgtggccgccgggaaccaccaccacgccgccatgctcgacgtggacctgcaccccgcgtccgcctggaccctgtacgccgtcgccacgaccatcatcaccccgatgatgcgccacaccatcgagaacacgaccgccaacatcagcctcaccgcgatcgccaaccaggccgccatcctgatgggcctggacaagggctggcccatctccaagatggacatcggggtgcccctcctggcgctgggctgctacagccaggtgaaccccctcaccctgacggccgccgtcctgatgctcgtggcccactacgccatcatcgggccgggcctgcaggcgaaggccacccgcgaggcccagaagcggaccgccgccgggatcatgaagaaccccaccgtggacggcatcgtcgcgatcgacctggaccccgtggtgtacgacgccaagttcgagaagcagctcggccagatcatgctgctgatcctctgcacgtcccagatcctgctgatgcgcaccacctgggccctctgcgagagcatcaccctggccacggggcccctgaccaccctctgggagggctccccggggaagttctggaacaccacgatcgccgtcagcatggcgaacatcttccggggctcctacctggccggcgccgggctggccttcagcgtgatgaagtccctcggcgggggccgccgggggaccggcgcgcagggcgagaccctgggggagaagtggaagcgccagctgaaccagctctccaagagcgagttcaacacctacaagcggtccggcatcatggaggtggaccgcagcgaggccaaggaggggctgaagcggggcgagacgaccaagcacgccgtctcccgcgggaccgccaagctgcggtggttcgtggagcgcaacctcgtgaagcccgagggcaaggtcatcgacctgggctgcgggcggggcgggtggagctactactgcgccggcctgaagaaggtgaccgaggtgaaggggtacacgaagggcggccccgggcacgaggagcccatcccgatggcgacctacggctggaacctggtcaagctccactccgggaaggacgtgttcttcgtgccgcccgagaagtgcgacaccctgctgtgcgacatcggcgagagctcccccaacccgaccatcgaggaggggcgcacgctccgggtcctgaagatggtggagccctggctgcgcggcaaccagttctgcatcaagatcctcaacccctacatgcccagcgtggtcgagaccctggagcagatgcagcggaagcacggcgggatgctggtgcgcaacccgctctcccggaacagcacccacgagatgtactgggtgtcctgcggcaccgggaacatcgtcagcgccgtgaacatgacctcccgcatgctgctgaaccgcttcacgatggcccaccggaagcccacctacgagcgcgacgtggacctcggcgccggcacccggcacgtcgccgtggagcccgaggtggcgaacctggacatcatcgggcagcgcatcgagaacatcaagcacgagcacaagagcacctggcactacgacgaggacaacccctacaagacgtgggcctaccacggctcctacgaggtcaagccgagcgggtccgccagcagcatggtgaacggcgtcgtgaagctgctcaccaagccctgggacgtgatccccatggtcacccagatcgccatgaccgacacgacccccttcgggcagcagcgggtgttcaaggagaaggtggacacccgcaccccgaaggccaagcggggcacggcgcagatcatggaggtcaccgccaagtggctgtggggcttcctgtcccgcaacaagaagccccggatctgcacccgcgaggagttcacccggaaggtgcgcagcaacgccgccatcggggcggtgttcgtcgacgagaaccagtggaactccgccaaggaggccgtggaggacgagcggttctgggacctcgtgcaccgcgagcgggagctgcacaagcagggcaagtgcgccacgtgcgtctacaacatgatggggaagcgcgagaagaagctgggcgagttcgggaaggccaagggcagccgggcgatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgccgacgacaccgccgggtgggacacccggatcaccgaggacgacctgcagaacgaggcgcgcatcacggacatcatggagccggagcacgccctgctcgccaagtccatcttcaagctgacctaccagaacaaggtggtccgcgtgcagcggcccgccaagaacggcaccgtgatggacgtcatcagccgccgggaccagcgcgggtccggccaggtgggcacctacgggctgaacacgttcaccaacatggaggcccagctcatccggcagatggagagcgagggcatcttctcccccagcgagctggagacccccatcctggcggagcgcgtgctcgactggctggagaagtacggggtcgagcggctgaagcgcatggccatctccggcgacgactgcgtggtgaagccgatcgacgaccggttcgccaccgccctcacggccctgaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctcgtggggcgggcgcgcgtgagccagggcgccgggtggagcctgcgggagaccgcctgcctgggcaagtcctacgcccagatgtggcagctcatgtacttccaccgccgggacctgcgcctggcggccaacgccatctgcagcgccgtccccgtggactggatccccacctcccggaccacgtggagcatccacgcccaccaccagtggatgaccaccgaggacatgctctccgtgtggaaccgcgtctggatcgaggagaacccctggatggaggacaagacccacatcagctcctggggcgacgtgccgtacctgggcaagcgcgaggaccagtggtgcggcagcctgatcgggctcacggcgcgggccacctgggccaccaacatccaggtggccatcaaccaggtccgccggctgatcggcaacgagaactacctggactacatgacctccatgaagcgcttcaagaacgagagcgaccccgagggggccctctggtga

SEQ ID NO: 8028 - RNA, 9879 nt, synthetic construct
  misc_feature 1..9879: note = derived and/or modified CDS sequence (opt1) from DENV-1__FJ639686__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgccccacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatccggtacgagggcaccgacgccccctgcaagatccccttcagcacccaggacgagcgcggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccgccggatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccttcagcatgacctgcatcgccgtggggctggtgaccctctacctgggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctctccgccgccatcggcaaggcctgggaggagggggtgtgcggcatccggagcgccacccgcctggagaacatcatgtggaagcagatctccaacgagctgaaccacatcctcctggagaacgacatgaagttcaccgtcgtggtgggggacgtcgcgggcatcctggcccaggggaagaagatgatccggccccagcccatggagtacaagtacagctggcgctcctggggcaaggccaagatcatcggcgccgacgtgcagaacacgaccttcatcatcgacgggcccaacaccccggagtgccccgacgaccagcgggcgtggaacatctgggaggtggaggactacggcttcgggatcttcaccacgaacatctggctcaagctgcgcgacagctacacccaggtctgcgaccaccggctgatgtccgccgccatcaaggacagcaaggccgtgcacgccgacatgggctactggatcgagtccgagaagaacgagacctggaagctcgcgcgcgccagcttcatcgaggtgaagacctgcatctggcccaagtcccacacgctgtggagcaacggcgtcctggagtccgagatgatcatccccaagatctacgggggcccgatcagccagcacaactaccggcccgggtacttcacccagaccgccggcccctggcacctcgggaagctggagctggacttcgacctctgcgagggcaccacggtggtggtcgacgagcactgcggcaaccgcgggccgtccctgcggaccaccaccgtgacgggcaagatcatccacgagtggtgctgccgcagctgcaccctgccgcccctccggttccgcggggaggacggctgctggtacgggatggagatccggcccgtgaaggagaaggaggagaacctggtcaagtccatggtgagcgccggcagcggcgaggtggactccttcagcctggggctcctgtgcatctccatcatgatcgaggaggtcatgcgcagccgctggtcccggaagatgctgatgaccggcaccctcgccgtgttcctgctgctcatcatggggcagctgacgtggaacgacctgatccgcctctgcatcatggtgggcgcgaacgccagcgaccggatggggatgggcaccacctacctggccctgatggccaccttcaagatgcgcccgatgttcgccgtcgggctcctgttccggcgcctgacgtcccgggaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtgctgagcatcgtctccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgcgacgacaccctgaccatcctcctgaaggccaccctgctcgccgtctccggcgtgtacccgctgagcatccccgccacgctgttcgtgtggtacttctggcagaagaagaagcagcggtccggggtcctctgggacacccccagcccgcccgaggtggagcgcgccgtgctggacgacggcatctaccggatcatgcagcgcggcctgctggggcggtcccaggtcggcgtgggggtgttccaggagaacgtcttccacaccatgtggcacgtgacccgcggcgcggtgctcatgtaccaggggaagcggctggagcccagctgggcctccgtcaagaaggacctgatcagctacggcggcgggtggcgcctccagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgggaggggaagatcgtgggcctgtacggcaacggggtggtcaccaccagcggcacctacgtgagcgccatcgcccaggccaaggcgtcccaggaggggccgctccccgagatcgaggacgaggtgttccgcaagcggaacctgacgatcatggacctgcaccccggcagcgggaagacccgccgctacctcccggccatcgtccgggaggccatcaagcgcaagctgcggaccctgatcctcgcccccacccgcgtggtggcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtgcgggtcccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagaccttcgacacggagtaccagaagaccaagaacaacgactgggactacgtggtgaccaccgacatcagcgagatgggcgcgaacttccgggccgaccgcgtcatcgacccgcggcgctgcctgaagcccgtgatcctgaaggacgggcccgagcgggtgatcctcgccggccccatgccggtcacggtggcctccgccgcgcagcgccgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtgtccggggacctgatcctcgagatcggcaagctgccgcagcacctgacccagcgggcccagaacgccctcgacaacctggtcatgctgcacaacagcgagcagggcgggcgcgcgtaccggcacgccatggaggagctccccgacaccatcgagacgctgatgctgctcgccctgatcgccgtgctgaccggcggggtgaccctcttcttcctgtccggccgcgggctgggcaagaccagcatcggcctcctgtgcgtcatggcctccagcgtgctgctctggatggcgtccgtggagccccactggatcgccgccagcatcatcctggagttcttcctgatggtcctcctgatccccgagccggaccgccagcggacgccccaggacaaccagctggcctacgtggtgatcgggctcctgttcatgatcctgacggtcgccgcgaacgagatgggcctcctggagaccaccaagaaggacctggggatcggccacgtggccgtggggaaccaccaccacgccgccatgctcgacgtcgacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatgggcctggacaagggctggcccatctccaagatggacatcggggtgcccctcctggccctgggctgctacagccaggtcaaccccctcaccctgacggcggccgtgctgatgctcgtggcccactacgccatcatcgggccgggcctgcaggccaaggcgacccgggaggcccagaagcgcaccgccgccgggatcatgaagaaccccaccgtcgacggcatcgtggccatcgacctggaccccgtggtctacgacgcgaagttcgagaagcagctcggccagatcatgctgctgatcctctgcacgtcccagatcctgctgatgcggaccacctgggccctctgcgagagcatcaccctggccacggggcccctgaccaccctctgggagggctccccggggaagttctggaacaccacgatcgccgtgagcatggccaacatcttccgcggctcctacctggcgggcgccgggctggccttcagcctcatgaagtccctgggcgggggccggcgcgggaccggcgcccagggcgagaccctgggggagaagtggaagcggcagctcaaccagctgtccaagagcgagttcaacacctacaagcgctccggcatcatggaggtggaccggagcgaggcgaaggaggggctgaagcgcggcgagatcacgaagcacgccgtctcccgggggaccgccaagctccgctggttcgtggagcggaacctggtgaagcccgagggcaaggtcatcgacctgggctgcgggcgcggcgggtggagctactactgcgccggcctgaagaaggtgaccgaggtgaaggggtacaccaagggcggccccgggcacgaggagcccatcccgatggccacgtacggctggaacctcgtcaagctgcactccgggaaggacgtgttcttcgtgccgcccgagaagtgcgacaccctgctctgcgacatcggcgagagctcccccaacccgaccatcgaggaggggcggaccctgcgcgtcctgaagatggtggagccctggctccggggcaaccagttctgcatcaagatcctgaacccctacatgcccagcgtggtcgagacgctggagcagatgcagcgcaagcacggcgggatgctcgtgcgcaacccgctgtcccggaacagcacccacgagatgtactgggtgtcctgcggcaccgggaacatcgtcagcgcggtgaacatgacctcccgcatgctgctcaaccggttcaccatggcccaccgcaagcccacgtacgagcgggacgtggacctgggcgccggcacccgccacgtcgccgtggagcccgaggtggccaacctggacatcatcgggcagcggatcgagaacatcaagcacgagcacaagagcacctggcactacgacgaggacaacccctacaagacctgggcgtaccacggctcctacgaggtcaagccgagcgggtccgccagcagcatggtgaacggcgtcgtgaagctcctgacgaagccctgggacgtgatccccatggtcacccagatcgccatgaccgacaccacgcccttcgggcagcagcgcgtgttcaaggagaaggtggacacccggaccccgaaggccaagcgcggcaccgcccagatcatggaggtcacggcgaagtggctgtggggcttcctctcccggaacaagaagccccgcatctgcacccgggaggagttcacccgcaaggtgcggagcaacgccgccatcggggccgtgttcgtcgacgagaaccagtggaactccgcgaaggaggccgtggaggacgagcgcttctgggacctggtgcaccgggagcgcgagctgcacaagcagggcaagtgcgcgacctgcgtctacaacatgatggggaagcgggagaagaagctcggcgagttcgggaaggccaagggcagccgcgccatctggtacatgtggctgggcgcgcggttcctggagttcgaggccctcgggttcatgaacgaggaccactggttctcccgcgagaacagcctgtccggcgtggagggggagggcctgcacaagctcgggtacatcctgcgcgacatcagcaagatccccggcggcaacatgtacgccgacgacacggccgggtgggacacccggatcaccgaggacgacctgcagaacgaggcccgcatcaccgacatcatggagccggagcacgcgctcctggccaagtccatcttcaagctgacgtaccagaacaaggtggtccgggtgcagcgccccgccaagaacggcaccgtgatggacgtcatcagccggcgcgaccagcgggggtccggccaggtgggcacctacgggctcaacaccttcacgaacatggaggcccagctgatccgccagatggagagcgagggcatcttctcccccagcgagctggagacccccaacctcgccgagcgggtgctggactggctggagaagtacggggtcgagcgcctcaagcggatggcgatctccggcgacgactgcgtggtgaagccgatcgacgaccgcttcgccaccgccctgaccgccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgcggggtggagcctgcgcgagacggcctgcctcggcaagtcctacgcccagatgtggcagctgatgtacttccaccggcgcgacctgcgcctcgccgcgaacgccatctgcagcgccgtccccgtggactggatccccacctcccggaccacctggagcatccacgcccaccaccagtggatgacgaccgaggacatgctgtccgtgtggaaccgcgtctggatcgaggagaacccctggatggaggacaagacccacatcagctcctggggcgacgtgccgtacctgggcaagcgggaggaccagtggtgcggcagcctcatcgggctgaccgcccgcgcgacgtgggccaccaacatccaggtggccatcaaccaggtccggcgcctgatcggcaacgagaactacctcgactacatgacctccatgaagcggttcaagaacgagagcgaccccgagggggccctgtggtga

SEQ ID NO: 8029 - RNA, 9879 nt, synthetic construct
  misc_feature 1..9879: note = derived and/or modified CDS sequence (opt1) from DENV-1__FJ639687__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccggatcagcgaggccgagcccgacgacgtggactgctggtgcaacgccaccgacacctgggtcacctacgggacctgctcccagaccggcgagcaccggcgcgacaagcggagcgtggccctggcgccccacgtgggcctcgggctggagacccggacggagacctggatgtccagcgagggcgcctggaagcagatccagcgggtcgagacctgggccctgcgccaccccgggttcaccgtgatcgccctcttcctggcgcacgccatcggcacgtccatcacccagaaggggatcatcttcatcctgctcatgctggtgacccccagcatggccatgcggtgcgtcggcatcggctcccgcgacttcgtggaggggctgagcggcgccacctgggtggacgtcgtgctcgagcacgggtcctgcgtgacgaccatggccaaggacaagcccaccctggacatcgagctgctcaagaccgaggtcacgaaccccgcggtgctgcggaagctgtgcatcgaggccaagatcagcaacaccaccaccgactcccgctgcccgacgcagggcgaggccaccctcgtggaggagcaggacgccaacttcgtctgccggcgcaccttcgtggaccggggctgggggaacggctgcgggctgttcggcaaggggagcctgatcacgtgcgccaagttcaagtgcgtgacgaagctcgagggcaagatcgtccagtacgagaacctgaagtactccgtgatcgtgaccgtccacaccggcgaccagcaccaggtggggaacgagagcaccgagcacggcacgaccgcgaccatcacgccccaggccccctccaccgagatccagctgacggactacggggccctcaccctggactgcagcccccgcaccggcctggacttcaacgagatggtcctcctgaccatgaaggagaagtcctggctggtgcacaagcagtggttcctcgacctgccgctgccctggacgtccggggccagcacctcccaggagacctggaaccggcaggacctcctggtgaccttcaagacggcccacgcgaagaagcaggaggtcgtggtgctgggcagccaggagggcgccatgcacaccgccctcaccggggccaccgagatccagacgtccggcaccaccaccatcttcgccgggcacctgaagtgccgcctgaagatggacaagctcacgctgaagggcatgagctacgtcatgtgcaccgggtccttcaagctggagaaggaggtggcggagacccagcacggcaccgtgctcgtccagatcaagtacgagggcacggacgccccctgcaagatccccttcagcacccaggacgagaagggggtgacccagaacggccggctgatcaccgccaacccgatcgtgacggacaaggagaagcccgtcaacatcgaggccgagccgcccttcggggagtcctacatcgtgatcggcgcgggcgagaaggccctgaagctgagctggttcaagaaggggtccagcatcggcaagatgttcgaggccaccgcccgcggggcccggcgcatggcgatcctcggcgacaccgcctgggacttcgggtccatcggcggcgtgttcaccagcgtcgggaagctggtgcaccagatcttcggcacggcctacggggtgctgttctccggcgtcagctggaccatgaagatcgggatcggcgtgctcctgacctggctgggcctcaactcccgcagcacctccctgagcatgacgtgcatcgccgtggggctggtcaccctctacctgggcgtgatggtgcaggccgacagcgggtgcgtcatcaactggaagggccgggagctgaagtgcgggtccggcatcttcgtgaccaacgaggtgcacacctggacggagcagtacaagttccaggcggacagcccgaagcgcctctccgccgccatcggcaaggcctgggaggagggggtctgcggcatccggagcgccacccgcctggagaacatcatgtggaagcagatctccaacgagctgaaccacatcctcctggagaacgacatgaagttcaccgtggtggtcggggacgtggcgggcatcctggcccaggggaagaagatgatccggccccagcccatggagtacaagtacagctggaagtcctggggcaaggccaagatcatcggcgccgacgtgcagaacaccaccttcatcatcgacgggcccaacacgccggagtgccccgacgaccagcgcgcgtggaacatctgggaggtcgaggactacggcttcgggatcttcaccaccaacatctggctcaagctgcgggacagctacacccaggtgtgcgaccaccgcctgatgtccgccgccatcaaggacagcaaggccgtgcacgccgacatgggctactggatcgagtccgagaagaacgagacgtggaagctcgcgcgggccagcttcatcgaggtcaagacctgcatctggcccaagtcccacaccctgtggagcaacggcgtgctggagtccgagatgatcatccccaagatctacgggggcccgatcagccagcacaactaccgccccgggtacttcacccagacggccggcccctggcacctcgggaagctggagctggacttcgacctctgcgagggcaccaccgtggtcgtggacgagcactgcggcaaccgggggccgtccctgcgcaccacgaccgtgaccggcaagatcatccacgagtggtgctgccggagctgcaccctgccgcccctgcgcttcaagggggaggacggctgctggtacgggatggagatccggcccgtcaaggagaaggaggagaacctggtcaagagcatggtgtccgccggcagcggcgaggtcgactccttcagcctggggctcctgtgcatctccatcatgatcgaggaggtgatgcgcagccggtggtcccgcaagatgctgatgacgggcaccctcgccgtgttcttcctgctgatcatggggcagctcacctggaacgacctgatccggctgtgcatcatggtcggcgcgaacgccagcgaccgcatggggatgggcatgacctacctcgccctgatggccacgttcaagatgcgcccgatgttcgccgtgggcctcctgttccggcgcctgacctcccgggaggtgctgctcctgaccatcgggctgagcctcgtcgcgtccgtggagctgcccaacagcctggaggagctcggcgacgggctggccatgggcatcatgatcctgaagctcctgaccgacttccagtcccaccagctgtgggccacgctcctgagcctgaccttcatcaagaccaccttctccctccactacgcctggaagacgatggcgatggtcctgagcatcgtgtccctgttccccctctgcctgagcaccacctcccagaagaccacgtggctgcccgtgctcctgggcagcctggggtgcaagccgctcaccatgttcctgatcgccgagaacaagatctggggccgcaagagctggcccctgaacgaggggatcatggccgtcggcatcgtgtccatcctcctgagctccctgctcaagaacgacgtgcccctggccgggcccctgatcgccggcggcatgctcatcgcgtgctacgtcatcagcgggtccagcgccgacctgtccctggagaaggccgccgaggtgagctgggaggaggaggccgagcactccggcgcgagccacaacatcctcgtggaggtccaggacgacgggaccatgaagatcaaggacgaggagcgggacgacaccctgacgatcctgctcaaggccaccctgctggccgtgtccggcgtgtacccgctcagcatccccgccaccctgttcgtctggtacttctggcagaagaagaagcagcgctccggggtgctgtgggacacccccagcccgcccgaggtggagcgggccgtcctcgacgacggcatctaccgcatcatgcagcggggcctgctggggcgctcccaggtgggcgtgggggtcttccaggagaacgtgttccacaccatgtggcacgtgacgcggggcgcggtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagaccgcccccgggaccttcaagacgagcgagggcgaggtcggcgccatcgcgctcgacttcaagcccgggaccagcggctcccccatcgtgaaccgcgaggggaagatcgtgggcctgtacggcaacggggtcgtgaccaccagcggcacgtacgtgtccgccatcgcccaggccaaggcgagccaggaggggcccctgccggagatcgaggacgaggtcttccggaagcgcaacctcaccatcatggacctgcaccccggctccgggaagacccggcgctacctgcccgccatcgtgcgggaggccatcaagcgcaagctccggaccctgatcctggccccgacgcgcgtggtcgccagcgagatggcggaggccctcaagggcatgcccatccgctaccagaccaccgccgtgaagtccgagcacaccggcaaggagatcgtggacctgatgtgccacgccacgttcaccatgcggctgctcagccccgtccgcgtgcccaactacaacatgatcatcatggacgaggcccacttcaccgacccgtccagcatcgcggcccgggggtacatctccacccgcgtgggcatgggggaggccgccgccatcttcatgacggcgacgccgcccggcagcgccgaggccttcccccagtccaacgccgtcatccaggacgaggagcgggacatcccggagcgcagctggaactccgggtacgagtggatcaccgacttccccggcaagaccgtgtggttcgtgcccagcatcaagtccggcaacgacatcgcgaactgcctgcggaagaacgggaagcgcgtcatccagctgagccggaagacgttcgacaccgagtaccagaagaccaagaacaacgactgggactacgtggtgaccacggacatctccgagatgggcgccaacttccgcgccgaccgggtcatcgacccccgccggtgcctcaagccggtgatcctgaaggacgggcccgagcgcgtgatcctggccggccccatgcccgtcaccgtggccagcgcggcccagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgcggccatcgacggggagtaccgcctgcgcggcgaggcccggaagacgttcgtcgagctgatgcgccgcggggacctcccggtgtggctgtcctacaaggtggccagcgagggcttccagtactccgaccgccggtggtgcttcgacggcgagcgcaacaaccaggtcctggaggagaacatggacgtggagatctggaccaaggagggggagcggaagaagctccgcccccggtggctggacgcccgcacctacagcgaccccctggcgctccgggagttcaaggagttcgccgccggccgccggtccgtgagcggggacctgatcctggagatcggcaagctcccccagcacctgacccagcgcgcccagaacgcgctggacaacctcgtcatgctgcacaactccgagcagggcgggcgggcctaccgccacgccatggaggagctgccggacacgatcgagaccctcatgctgctggccctcatcgccgtgctgaccggcggggtgaccctgttcttcctcagcggccgggggctgggcaagacgtccatcggcctgctctgcgtcatggcgagctccgtgctgctgtggatggccagcgtggagccccactggatcgccgcctccatcatcctcgagttcttcctgatggtcctgctcatccccgagcccgaccgccagcggaccccgcaggacaaccagctggcctacgtggtgatcgggctcctcttcatgatcctgaccgtcgcggccaacgagatgggcctgctcgagaccaccaagaaggacctggggatcggccacgtggccgtggagaaccaccaccacgccgccatgctggacgtcgacctccaccccgcgagcgcctggacgctgtacgccgtggccaccaccatcatcacccccatgatgcgccacacgatcgagaacaccaccgccaacatctccctgaccgcgatcgccaaccaggccgccatcctcatggggctggacaagggctggccgatcagcaagatggacatcggcgtgcccctgctcgcgctggggtgctactcccaggtcaaccccctgacgctcaccgccgccgtgctgatgctggtggcccactacgccatcatcggccccgggctccaggcgaaggccacccgggaggcccagaagcgcaccgccgccggcatcatgaagaacccgacggtcgacgggatcgtggcgatcgacctggaccccgtggtctacgacgccaagttcgagaagcagctgggccagatcatgctcctgatcctgtgcaccagccagatcctcctgatgcgcaccacctgggccctgtgcgagtccatcacgctcgccaccggccccctgaccaccctgtgggaggggagccccggcaagttctggaacacgaccatcgccgtgagcatggcgaacatcttccgggggtcctacctcgccggcgccggcctggccttcagcctgatgaagtccctcgggggcgggcgccggggcaccggggcgcagggcgagaccctgggcgagaagtggaagcgccagctgaaccagctcagcaagtccgagttcaacacgtacaagcggagcgggatcatggaggtggaccgctccgaggccaaggagggcctgaagcgcggggagaccaccaagcacgccgtcagccgcggcaccgccaagctgcggtggttcgtggagcgcaacctcgtgaagccggaggggaaggtcatcgacctgggctgcggccgcggcgggtggtcctactactgcgccgggctgaagaaggtgacggaggtgaaggggtacaccaagggcgggcccggccacgaggagcccatccccatggcgacctacgggtggaacctggtcaagctccacagcggcaaggacgtgttcttcgtgccgcccgagaagtgcgacaccctgctgtgcgacatcggggagtccagccccaaccccacgatcgaggagggccgcaccctccgggtcctgaagatggtggagccgtggctgcgcgggaaccagttctgcatcaagatcctcaacccctacatgccctccgtggtcgagaccctggagcagatgcagcggaagcacggcggcatgctggtgcgcaaccccctcagccggaactccacccacgagatgtactgggtgagctgcgggacgggcaacatcgtctccgccgtgaacatgaccagccgcatgctgctgaaccggttcaccatggcccaccgcaagccgacctacgagcgcgacgtggacctcggggccggcacccggcacgtcgccgtggagcccgaggtggcgaacctggacatcatcggccagcgcatcgagaacatcaagcacgagcacaagtccacgtggcactacgacgaggacaacccctacaagacctgggcctaccacgggagctacgaggtcaagcccagcggctccgccagctccatggtgaacggggtcgtgaagctgctcaccaagccgtgggacgtgatccccatggtcacccagatcgccatgacggacaccacccccttcggccagcagcgggtgttcaaggagaaggtggacacccgcacgcccaaggccaagcgggggaccgcgcagatcatggaggtcaccgccaagtggctgtggggcttcctgagccgcaacaagaagccgcggatctgcacccgcgaggagttcacgcggaaggtgcgctccaacgccgccatcggcgcggtgttcgtcgacgagaaccagtggaacagcgccaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggtcccgggcgatctggtacatgtggctcggcgcccgcttcctggagttcgaggccctgggcttcatgaacgaggaccactggttcagccgggagaactccctcagcggggtggagggcgaggggctgcacaagctgggctacatcctccgcgacatctccaagatcagcgggggcaacatgtacgccgacgacaccgccggctgggacacccggatcacggaggacgacctgcagaacgaggcgaagatcaccgacatcatggagcccgagcacgccctgctcgccaagtccatcttcaagctgacctaccagaacaaggtggtccgcgtgcagcggcccgccaagaacgggaccgtgatggacgtcatcagccgccgcgaccagcggggctccggccaggtgggcacgtacggcctgaacaccttcaccaacatggaggcccagctcatccgccagatggagagcgaggggatcttctccccgagcgagctggagacccccaacctggcggagcgggccctcgactggctggagaagcacggcgtggagcgcctgaagcggatggccatcagcggggacgactgcgtcgtgaagcccatcgacgaccgcttcgccacggccctcaccgcgctgaacgacatgggcaaggtgcggaaggacatcccccagtgggagccgtccaaggggtggaacgactggcagcaggtccccttctgcagccaccacttccaccagctgatcatgaaggacggccgcgagatcgtggtgccctgccggaaccaggacgagctcgtcggccgcgcccgggtgtcccagggggccggctggagcctgaaggagaccgcctgcctggggaagtcctacgcgcagatgtggcagctcatgtacttccaccgccgggacctgcgcctggccgccaacgccatctgcagcgccgtgcccgtcgactgggtgccgacctcccggacgacctggagcatccacgcgcaccaccagtggatgaccaccgaggacatgctctccgtgtggaaccgcgtctggatcgaggagaacccctggatggaggacaagacgcacatcagctcctgggaggacgtgccctacctgggcaagcgggaggaccagtggtgcgggagcctgatcggcctcaccgcccgcgccacctgggccaccaacatccaggtggccatcaaccaggtccggcgcctgatcggcaacgagaactacctggactacatgacgtccatgaagcgcttcaagaacgagagcgaccccgagggggcgctctggtga

SEQ ID NO: 8030 - RNA, 9879 nt, synthetic construct
  misc_feature 1..9879: note = derived and/or modified CDS sequence (opt1) from DENV-1__FJ639688__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgaggccgagcccgacgacgtggactgctggtgcaacgccaccgacacctgggtgacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtcgagacctgggccctccggcaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacgtctgggaggtggaggactacggcttcgggatcttcaccacgaacatctggctgaagctgcgggacagctacacccaggtgtgcgaccaccgcctcatgtccgccgccatcaaggacagcaaggccgtccacgccgacatgggctactggatcgagtccgagaagaacgagacctggaagctggcgcgggccagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttccgcggggaggacggctgctggtacgggatggagatccgccccgtgaaggagaaggaggagaacctggtgaagtccatggtcagcgccggcagcggcgaggtggactccttcagcctcgggctgctgtgcatctccatcatgatcgaggaggtgatgcggagccgctggtcccggaagatgctcatgaccggcaccctggccgtcttcttcctgctcatcatggggcagctgacgtggaacgacctgatccgcctctgcatcatggtgggcgcgaacgccagcgaccgcatggggatgggcaccacctacctggccctgatggccaccttcaagatgcggccgatgttcgccgtgggcctcctgttccgccggctgacgtcccgcgaggtcctcctgctgaccatcgggctcagcctggtggcgtccgtcgagctgcccaccagcctcgaggagctgggcgacgggctggccatgggcatcatgatcctcaagctgctgaccgacttccagtcccaccagctctgggccacgctgctgagcctcaccttcatcaagaccaccttctccctgcactacgcctggaagacgatggcgatggtgctgagcatcgtgtccctcctgcccctgtgcctcagcaccacctcccagaagaccacgtggctgcccgtcctgctcggcagcctggggtgcaagccgctgaccatgttcctcatcgccgagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcgtgctacgtgatcagcgggtccagcgccgacctctccctggagaaggccgccgaggtgagctgggaggaggaggccgagcactccggcgcgagccacaacatcctggtcgaggtgcaggacgacgggaccatgaagatcaaggacgaggagcgggacgacaccctcaccatcctgctgaaggccacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgcggtgctgatgtaccaggggaagcgcctggagcccagctgggcctccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgcgctggacttcaagcccgggaccagcggctcccccatcgtgaaccgcgaggggaagatcgtcggcctctacggcaacggggtggtgaccaccagcggcacgtacgtcagcgccatcgcccaggccaaggcgtcccaggaggggccgctgcccgagatcgaggacgaggtgttccggaagcgcaacctgaccatcatggacctccaccccggcagcgggaagacccggcgctacctgccggccatcgtgcgggaggccatcaagcgcaagctgcgcaccctcatcctggcccccacgcgggtcgtggcctccgagatggcggaggccctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgcggcccgggggtacatcagcacccgcgtcggcatgggggaggccgccgccatcttcatgacggcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgcgaacttccgcgccgaccgggtgatcgacccgcgccggtgcctgaagcccgtcatcctcaaggacgggcccgagcgcgtgatcctggccggccccatgccggtcaccgtggcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagacgttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtgatgctccacaacagcgagcagggcgggcgggcgtaccgccacgccatggaggagctgcccgacacgatcgagaccctgatgctcctggccctgatcgccgtcctcaccggcggggtgaccctgttcttcctgtccggccgggggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccgccagcggacgccccaggacaaccagctcgcctacgtcgtgatcgggctgctgttcatgatcctcaccgtggccgcgaacgagatgggcctgctggagaccaccaagaaggacctcgggatcggccacgtcgccgccgagaaccaccaccacgccgccatgctggacgtggacctgcaccccgcgtccgcctggacgctctacgccgtggccaccaccatcatcaccccgatgatgcgccacacgatcgagaacaccaccgccaacatcagcctgaccgcgatcgccaaccaggccgccatcctgatggggctcgacaagggctggcccatctccaagatggacatcggcgtccccctgctggcgctcgggtgctacagccaggtgaaccccctgacgctgaccgccgccgtgctcatgctggtcgcccactacgccatcatcggcccggggctgcaggcgaaggccacccgcgaggcccagaagcggaccgccgccggcatcatgaagaaccccacggtggacgggatcgtggcgatcgacctcgaccccgtcgtgtacgacgccaagttcgagaagcagctgggccagatcatgctgctcatcctgtgcacctcccagatcctgctcatgcgcaccacctgggccctgtgcgagagcatcacgctggccaccggccccctcaccaccctgtgggaggggtccccgggcaagttctggaacacgaccatcgccgtgagcatggcgaacatcttccgggggtcctacctggccggcgccggcctcgccttcagcctgatgaagtccctcgggggcgggcgccgggggaccggggcgcagggcgagaccctcggcgagaagtggaagcgccagctgaaccagctgtccaagagcgagttcaacacgtacaagcggtccgggatcatggaggtcgaccgcagcgaggccaaggagggcctcaagcgcggggagaccaccaagcacgccgtgtcccgcggcaccgccaagctgcggtggttcgtggagcgcaacctggtcaagcccgaggggaaggtgatcgacctgggctgcggccgcgggggctggagctactactgcgccgggctcaagaaggtgacggaggtcaagggctacaccaagggcggccccggccacgaggagcccatcccgatggcgacctacgggtggaacctggtgaagctgcactccggcaaggacgtgttcttcatcccgcccgagaagtgcgacaccctcctgtgcgacatcggggagagctcccccaacccgacgatcgaggagggccgcaccctgcgggtcctcaagatggtggagccctggctgcgcgggaaccagttctgcatcaagatcctgaacccctacatgcccagcgtggtcgagaccctcgagcagatgcagcggaagcacggcggcatgctggtgcgcaacccgctgtcccggaacagcacccacgagatgtactgggtgtcctgcgggaccggcaacatcgtcagcgccgtgaacatgacgtcccgcatgctcctgaaccgcttcaccatggcccaccggaagcccacctacgagcgcgacgtggacctgggggccggcacccggcacgtcgccgtggagcccgaggtggcgaacctcgacatcatcggccagcgcatcgagaacatcaagcacgagcacaagagcacgtggcactacgacgaggacaacccctacaagacctgggcctaccacgggtcctacgaggtcaagccgagcggctccgccagcagcatggtgaacggggtcgtgaagctgctgaccaagccctgggacgtgatccccatggtcacccagatggccatgacggacaccacccccttcggccagcagcgggtgttcaaggagaaggtggacacccgcacgccgaaggccaagcgggggaccgcgcagatcatggaggtcaccgccaagtggctctggggcttcctgtcccgcaacaagaagccccggatctgcacccgcgaggagttcacgcggaaggtgcgcagcaacgccgccatcggcgcggtgttcgtcgacgagaaccagtggaactccgccaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggcgatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcgcgcatcaccgacatcatggagccggagcacgccctgctggccaagtccatcttcaagctcacctaccagaacaaggtggtccgcgtgcagcggcccgccaagaacgggaccgtgatggacgtcatcagccgccgggaccagcgcggctccggccaggtggggacgtacggcctgaacaccttcaccaacatggaggcccagctgatccggcagatggagagcgaggggatcttctcccccagcgagctcgagacccccaacctggcggagcgcgtgctggactggctcgagaagtacggcgtcgagcggctgaagcgcatggccatctccggggacgactgcgtggtgaagccgatcgacgaccggttcgccacggccctgaccgccctcaacgacatgggcaaggtccgcaaggacatcccccagtgggagcccagcaaggggtggaacgactggcagcaggtccccttctgctcccaccacttccaccagctgatcatgaaggacggccgggagatcgtggtcccgtgccgcaaccaggacgagctggtgggccgggcgcgcgtgagccagggggccggctggagcctccgggagaccgcctgcctggggaagtcctacgcccagatgtggcagctgatgtacttccaccgccgggacctccgcctggcggccaacgccatctgcagcgccgtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctcgggaagcgcgaggaccagtggtgcggcagcctgatcggcctgaccgcgcgggccacctgggccaccaacatccaggtggccatctaccaggtccgccggctcatcgggaacgagaactacctggactacatgacctccatgaagcgcttcaagaacgagagcgaccccgagggcgccctgtggtga

SEQ ID NO: 8031 - RNA, 9879 nt, synthetic construct
  misc_feature 1..9879: note = derived and/or modified CDS sequence (opt1) from DENV-1__FJ639689__SS-prME
  source 1..9879: mol_type = other RNA
agcgtgaccatgctgctcatgctgatgcccaccgccctggccttccacctcaccatccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacccgcacggagacctggatgagctccgagggcgcctggaagcagatccagcgggtcgagacctgggccctccgccaccccgggttcaccgtgatcgccctgttcctggcgcacgccatcggcacgagcatcacccagaaggggatcatcttcatcctcctgatgctggtgaccccctccatggccatgcggtgcgtcggcatcggcagccgcgacttcgtggaggggctctccggcgccacctgggtggacgtcgtgctggagcacgggagctgcgtgacgaccatggccaaggacaagcccaccctggacatcgagctcctgaagaccgaggtcacgaaccccgcgatcctgcggaagctctgcatcgaggccaagatctccaacaccaccaccgacagccgctgcccgacgcagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgacgaagctggagggcaagatcgtgcagtacgagaacctgaagtacagcgtcatcgtgaccgtgcacaccggcgaccagcaccaggtcgggaacgagtccaccgagcacggcacgaccgcgaccatcacgccccaggcccccaccacggagatccagctcaccgactacggggccctgaccctggactgcagcccccgcaccggcctcgacttcaacgagatggtgctgctgacgatgaaggagaagtcctggctcgtccacaagcagtggttcctggacctgccgctcccctggaccagcggggccagcacctcccaggagacctggaaccggcaggacctgctggtgacgttcaagaccgcccacgcgaagaagcaggaggtggtcgtgctcggcagccaggagggcgccatgcacaccgccctgaccggggccacggagatccagacctccggcaccaccacgatcttcgccgggcacctgaagtgccgcctcaagatggacaagctgaccctgaagggcatgagctacgtgatgtgcaccgggtccttcaagctcgagaaggaggtcgcggagacccagcacggcacggtgctggtgcagatcaagtacgagggcaccgacgccccctgcaagatccccttcagcacccaggacgagaagggggtcacccagaacggccggctgatcacggccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccatcggcggcgtgttcacgagcgtggggaagctggtccaccagatcttcggcaccgcctacggggtgctgttctccggcgtgagctggaccatgaagatcgggatcggcgtcctgctgacctggctcggcctgaactcccgcagcacgtccttcagcatgacctgcatcgccgtggggctggtgaccctctacctgggcgtcatggtgcaggccgactccgggtgcgtgatcaactggaagggccgggagctgaagtgcgggagcggcatcttcgtcaccaacgaggtgcacacgtggaccgagcagtacaagttccaggcggacagcccgaagcgcctctccgccgccatcggcaaggcctgggaggagggggtgtgcggcatccggagcgccacccgcctggagaacatcatgtggaagcagatctccaacgagctgaaccacatcctcctggagaacgacatgaagttcaccgtcgtggtgggggacgtcgcgggcatcctggcccaggggaagaagatgatccggccccagcccatggagtacaagtacagctggcgctcctggggcaaggccaagatcatcggcgccgacgtgcagaacaccacgttcatcatcgacgggcccaacaccccggagtgccccgacgaccagcgggcgtggaacatctgggaggtggaggactacggcttcgggatcttcaccaccaacatctggctcaagctgcgcgacagctacacgcaggtctgcgaccaccggctgatgtccgccgccatcaaggacagcaaggccgtgcacgccgacatgggctactggatcgagtccgagaagaacgagacctggaagctcgcgcgcgccagcttcatcgaggtgaagacctgcgtctggcccaagtcccacaccctgtggagcaacggcgtgctggagtccgagatgatcatccccaagatctacgggggcccgatcagccagcacaactaccggcccgggtacttcacgcagaccgccggcccctggcacctcgggaagctggagctggacttcgacctctgcgagggcaccaccgtggtcgtggacgagcactgcggcaaccgcgggccgtccctgcggacgaccaccgtgaccggcaagatcatccacgagtggtgctgccgcagctgcacgctgccgcccctccggttccgcggggaggacggctgctggtacgggatggagatccggcccgtcaaggagaaggaggagaacctggtgaagtccatggtgagcgccggcagcggcgaggtcgactccttcagcctggggctcctgtgcatctccatcatgaccgaggaggtgatgcgcagccggtggtcccgcaagatgctgatgaccggcaccctcgccgtgttcctgctgctcatcatggggcagctgacgtggaacgacctgatccgcctctgcatcatggtcggcgcgaacgccagcgaccggatggggatgggcaccacctacctggccctgatggccaccttcaagatgcgcccgatgttcgccgtgggcctcctgttccggcgcctgacgtcccgggaggtgctcctgctgaccgtcgggctcagcctggtggcgtccgtcgagctgcccaacagcctcgaggagctgggcgacgggctggccatgggcatcatgatcctcaagctgctgaccgacttccagccccaccagctctgggccaccctgctgtccctcacgttcatcaagaccaccttcagcctgcactacgcctggaagaccatggcgatggtgctgtccatcgtgagcctcttccccctgtgcctgtccacgaccagccagaagaccacctggctcccggtcctgctgggctccctcgggtgcaagcccctgacgatgttcctgatcgccgagaacaagatctggggccgccggagctggcccctcaacgaggggatcatggccgtgggcatcgtgtccatcctgctgagcagcctcctgaagaacgacgtccccctggccgggccgctcatcgccggcgtgatgctgatcgcgtgctacgtgatctccggcagctccgccgacctgagcctcgagaaggccgccgaggtctcctgggaggaggaggccgagcacagcggggcgtcccacaacatcctggtggaggtgcaggacgacggcaccatgaagatcaaggacgaggagcgcgacgacaccctgaccatcctcctgaaggccaccctgctcgccgtcagcggggtgtaccccctgtccatccccgccacgctgttcgtgtggtacttctggcagaagaagaagcagcggagcggcgtcctctgggacaccccctccccgcccgaggtggagcgcgccgtgctggacgacgggatctaccggatcatgcagcgcggcctgctgggccggagccaggtcggggtgggcgtgttccaggagaacgtcttccacaccatgtggcacgtgacccgcggggcggtgctcatgtaccagggcaagcggctggagccctcctgggccagcgtcaagaaggacctgatctcctacgggggcggctggcgcctccaggggagctggaacacgggcgaggaggtccaggtgatcgccgtcgagcccgggaagaacccgaagaacgtgcagaccgcccccggcaccttcaagacccccgagggggaggtgggcgccatcgcgctggacttcaagcccggcacgtccgggagcccgatcgtcaaccgggagggcaagatcgtggggctgtacggcaacggcgtggtcaccacctccgggacctacgtgagcgccatcgcccaggccaaggcgagccaggagggccccctccccgagatcgaggacgaggtgttccgcaagcggaacctgacgatcatggacctgcacccggggtccggcaagacccgccggtacctccccgccatcgtccgcgaggccatcaagcgcaagctgcggaccctgatcctcgcccccacccgcgtggtggccagcgagatggcggaggccctgaaggggatgcccatccggtaccagacgaccgccgtcaagtccgagcacaccggcaaggagatcgtggacctgatgtgccacgccaccttcacgatgcgcctcctgagcccggtgcgggtccccaactacaacatgatcatcatggacgaggcccacttcaccgacccctccagcatcgcggcccgcggctacatctccacccgggtggggatgggcgaggccgccgccatcttcatgaccgcgacgcccccggggagcgtggaggccttcccccagtccaacgccgtcatccaggacgaggagcgcgacatccccgagcggagctggaactccggctacgagtggatcaccgacttccccgggaagaccgtgtggttcgtgccgagcatcaagtccggcaacgacatcgccaactgcctgcgcaagaacggcaagcgggtcatccagctcagccgcaagaccttcgacacggagtaccagaagaccaagaacaacgactgggactacgtggtgaccaccgacatctccgagatgggggcgaacttccgggccgaccgcgtcatcgacccccggcgctgcctgaagcccgtgatcctgaaggacggccccgagcgggtcatcctcgccgggccgatgcccgtgacggtggccagcgccgcgcagcgccggggccgcatcgggcgcaaccacaacaaggagggcgaccagtacatctacatgggccagcccctgaacaacgacgaggaccacgcccactggaccgaggccaagatgctgctcgacaacatcaacacccccgaggggatcatcccggccctgttcgagcccgagcgggagaagtccgccgcgatcgacggcgagtaccgcctgcgcggggaggcccgcaagaccttcgtcgagctcatgcggcgcggcgacctgcccgtgtggctgagctacaaggtggcctccgaggggttccagtacagcgaccggcgctggtgcttcgacggcgagcggaacaaccaggtcctcgaggagaacatggacgtggagatctggacgaaggagggcgagcgcaagaagctgcggccccgctggctggacgcccggacctacagcgacccgctcgccctgcgcgagttcaaggagttcgcggccgggcggcgctccgtgagcggcgacctgatcctcgagatcgggaagctgccccagcacctgacccagcgggcccagaacgccctcgacaacctggtcatgctgcacaactccgagcagggcggccgcgcgtaccggcacgccatggaggagctccccgacaccatcgagacgctgatgctgctcgccctgatcgccgtgctgaccgggggcgtgaccctcttcttcctgagcgggcgcggcctggggaagacctccatcggcctcctgtgcgtcatggccagctccgtgctgctctggatggcgagcgtggagccccactggatcgccgcctccatcatcctggagttcttcctgatggtcctcctgatcccggagcccgaccggcagcgcacgccccaggacaaccagctggcctacgtggtgatcggcctcctgttcatgatcctgacggtcgccgcgaacgagatggggctcctggagaccaccaagaaggacctgggcatcgggcacgtggccgtgggcaaccaccaccacgccgccatgctcgacgtcgacctgcacccggccagcgcgtggaccctgtacgccgtggccacgaccatcatcacccccatgatgcgccacaccatcgagaacacgaccgccaacatctccctcaccgccatcgcgaaccaggccgccatcctgatggggctggacaagggctggcccatcagcaagatggacatcggcgtgcccctcctggccctggggtgctactcccaggtcaacccgctcaccctgacggcggccgtgctgatgctcgtggcccactacgccatcatcggccccgggctgcaggccaaggcgacccgggaggcccagaagcgcaccgccgccggcatcatgaagaaccccaccgtcgacgggatcgtggccatcgacctggaccccgtggtctacgacgcgaagttcgagaagcagctcggccagatcatgctgctgatcctctgcacgagccagatcctgctgatgcggaccacctgggccctctgcgagtccatcaccctggccacgggcccgctgaccaccctctgggaggggagccccggcaagttctggaacaccacgatcgccgtgtccatggccaacatcttccgcgggagctacctggcgggcgccggcctggccttctccctcatgaagtccctcgggggcgggcggcgcgggaccggggcccagggcgagaccctgggcgagaagtggaagcggcagctcaaccagctgagcaagtccgagttcaacacctacaagcgcagcgggatcatggaggtggaccggtccgaggcgaaggagggcctgaagcgcggggagatcacgaagcacgccgtcagccggggcaccgccaagctccgctggttcgtggagcggaacctggtgaagcccgaggggaaggtcatcgacctgggctgcggccgcgggggctggtcctactactgcgccgggctgaagaaggtgaccgaggtgaagggctacaccaagggcgggcccggccacgaggagccgatccccatggccacgtacgggtggaacctcgtcaagctgcacagcggcaaggacgtgttcttcgtgccgcccgagaagtgcgacaccctgctctgcgacatcggggagtccagcccgaaccccaccatcgaggagggccggaccctgcgcgtcctgaagatggtggagccctggctccgggggaaccagttctgcatcaagatcctgaacccctacatgccgtccgtggtcgagacgctggagcagatgcagcgcaagcacggcggcatgctcgtgcggaaccccctgagccgcaactccacccacgagatgtactgggtgagctgcgggaccggcaacatcgtctccgcggtgaacatgaccagccgcatgctgctcaaccggttcaccatggcccaccgcaagcccacgtacgagcgggacgtggacctgggggccggcacccgccacgtcgccgtggagcccgaggtcgccaacctggacatcatcggccagcggatcgagaacatcaagcacgagcacaagtccacctggcactacgacgaggacaacccgtacaagacctgggcgtaccacgggagctacgaggtgaagccctccggcagcgcctccagcatggtgaacggggtcgtgaagctcctgacgaagccctgggacgtgatccccatggtcacccagatcgccatgaccgacaccacgccgttcggccagcagcgcgtgttcaaggagaaggtggacacccggacccccaaggccaagcgcgggaccgcccagatcatggaggtcacggcgaagtggctgtggggcttcctcagccggaacaagaagccccgcatctgcacccgggaggagttcacccgcaaggtgcggtccaacgccgccatcggcgccgtgttcgtcgacgagaaccagtggaacagcgcgaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggtcccgcgccatctggtacatgtggctgggcgcgcggttcctggagttcgaggccctcggcttcatgaacgaggaccactggttcagccgcgagaactccctgagcggggtggagggcgaggggctgcacaagctcggctacatcctgcgggacatctccaagatccccggcgggaacatgtacgccgacgacacggccgggtgggacacccgcatcaccgaggacgacctgcagaacgaggcccgcatcaccgacatcatggagcccgagcacgcgctcctggccaagagcatcttcaagctgacgtaccagaacaaggtggtccgggtgcagcgccccgccaagaacgggaccgtgatggacgtcatctcccggcgcgaccagcggggcagcggccaggtgggcacctacggcctcaacaccttcacgaacatggaggcccagctgatccgccagatggagtccgaggggatcttcagcccctccgagctggagaccccgaacctcgccgagcgggtgctggactggctggagaagtacggcgtcgagcgcctcaagcggatggcgatcagcggggacgactgcgtggtgaagcccatcgacgaccgcttcgccaccgccctgaccgccctgaacgacatgggcaaggtccggaaggacatcccccagtgggagccctccaaggggtggaacgactggcagcaggtcccgttctgcagccaccacttccaccagctcatcatgaaggacggccgcgagatcgtggtcccctgccggaaccaggacgagctggtgggccgcgcccgggtgtcccagggggcgggctggagcctgcgcgagacggcctgcctcggcaagagctacgcccagatgtggcagctgatgtacttccaccggcgcgacctgcggctcgccgcgaacgccatctgctccgccgtccccgtggactggatccccaccagccgcaccacctggtccatccacgcccaccaccagtggatgacgaccgaggacatgctgagcgtgtggaaccgcgtctggatcgaggagaacccgtggatggaggacaagacccacatctccagctggggcgacgtgccctacctggggaagcgggaggaccagtggtgcggctccctcatcggcctgaccgcccgcgcgacgtgggccaccaacatccaggtggccatcaaccaggtccggcgcctgatcgggaacgagaactacctcgactacatgaccagcatgaagcggttcaagaacgagtccgaccccgagggcgccctgtggtga

SEQ ID NO: 8032 - RNA, 9879 nt, synthetic construct
  misc_feature 1..9879: note = derived and/or modified CDS sequence (opt1) from DENV-1__FJ639690__SS-prME
  source 1..9879: mol_type = other RNA
agcgtgaccatgctgctcatgctgatgcccaccgccctggccttccacctcaccatccgcggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtcacctacgggacctgcagccagatcggcgagcaccggcgcgacaagcggtccgtggccctcgcgccccacgtgggcctggggctggagacccgcaccgagacctggatgagctccgagggcgcctggaagcagatccagcgggtcgagacctgggccctccgccaccccgggttcaccgtgatcgccctgttcctggcgcacgccatcggcaccagcatcacgcagaaggggatcatcttcatcctcctgatgctggtgaccccctccatggccatgcggtgcgtcggcatcggcagccgcgacttcgtggaggggctctccggcgccacctgggtggacgtcgtgctggagcacgggagctgcgtgaccacgatggccaaggacaagcccaccctggacatcgagctcctgaagaccgaggtcaccaaccccgcgatcctgcggaagctctgcatcgaggccaagatctccaacacgaccaccgacagccgctgcccgacccagggcgaggccacgctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgacggtgcacaccggcgaccagcaccaggtcgggaacgagtccaccgagcacggcaccacggcgaccatcacgccccaggcccccaccaccgagatccagctcacggactacggggccctgaccctggactgcagcccccgcaccggcctcgacttcaacgagatggtgctgctgaccatgaaggagaagtcctggctcgtccacaagcagtggttcctggacctgccgctcccctggacgagcggggccagcacctcccaggagacctggaaccggcaggacctgctggtgaccttcaagacggcccacgcgaagaagcaggaggtggtcgtgctcggcagccaggagggcgccatgcacaccgccctgaccggggccaccgagatccagacgtccggcaccaccaccatcttcgccgggcacctgaagtgccgcctcaagatggacaagctgacgctgaagggcatgagctacgtgatgtgcaccgggtccttcaagctcgagaaggaggtcgcggagacccagcacggcaccgtgctggtgcagatcaagtacgagggcacggacgccccctgcaagatccccttcagcacccaggacgagaagggggtcacccagaacggccggctgatcaccgccaacccgatcgtgacggacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccatcggcggcgtgttcaccagcgtggggaagctggtccaccagatcttcggcacggcctacggggtcctcttctccggcgtgagctggaccatgaagatcgggatcggcgtcctgctgacctggctcggcctgaactcccgcagcacctccttcagcatgacgtgcatcgccgtggggctggtgaccctctacctgggcgtcatggtgcaggccgactccgggtgcgtgatcaactggaagggccgggagctgaagtgcgggagcggcatcttcgtcaccaacgaggtgcacacctggacggagcagtacaagttccaggcggacagcccgaagcgcctctccgccgccatcggcaaggcctgggaggagggggtgtgcggcatccggagcgccacccgcctggagaacatcatgtggaagcagatctccaacgagctgaaccacatcctcctggagaacgacatgaagttcaccgtcgtggtgggggacgtcgcgggcatcctggcccaggggaagaagatgatccggccccagcccatggagtacaagtacagctggcgctcctggggcaaggccaagatcatcggcgccgacgtgcagaacaccaccttcatcatcgacgggcccaacacgccggagtgccccgacgaccagcgggcgtggaacatctgggaggtggaggactacggcttcgggatcttcaccaccaacatctggctcaagctgcgcgacagctacacccaggtctgcgaccaccggctgatgtccgccgccatcaaggacagcaaggccgtgcacgccgacatgggctactggatcgagtccgagaagaacgagacgtggaagctcgcgcgcgccagcttcatcgaggtgaagacctgcgtctggcccaagtcccacaccctgtggagcaacggcgtgctggagtccgagatgatcatccccaagatctacgggggcccgatcagccagcacaactaccggcccgggtacttcacccagacggccggcccctggcacctcgggaagctggagctggacttcgacctctgcgagggcaccaccgtggtcgtggacgagcactgcggcaaccgcgggccgtccctgcggaccacgaccgtgaccggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctggggctcctgtgcatctccatcatgacggaggaggtgatgcgcagccggtggtcccgcaagatgctgatgaccggcaccctcgccgtgttcctgctgctcatcatggggcagctgacctggaacgacctgatccgcctctgcatcatggtcggcgcgaacgccagcgaccggatggggatgggcacgacctacctggccctgatggccaccttcaagatgcgcccgatgttcgccgtggggctcctgttccggcgcctgacctcccgggaggtgctcctgctgacggtcgggctcagcctggtggcgtccgtcgagctgcccaacagcctcgaggagctgggcgacgggctggccatgggcatcatgatcctcaagctgctgaccgacttccagccccaccagctctgggccaccctgctgtccctcaccttcatcaagacgaccttcagcctgcactacgcctggaagaccatggcgatggtgctgtccatcgtgagcctcttccccctgtgcctgtccaccacgagccagaagaccacctggctcccggtcctgctgggctccctcgggtgcaagcccctgaccatgttcctgatcgccgagaacaagatctggggccgccggagctggcccctcaacgaggggatcatggccgtgggcatcgtgtccatcctgctgagcagcctcctgaagaacgacgtccccctggccgggccgctcatcgccggcggcatgctgatcgcgtgctacgtgatctccgggagctccgccgacctgagcctcgagaaggccgccgaggtgtcctgggaggaggaggccgagcacagcggcgcgtcccacaacatcctggtcgaggtgcaggacgacgggacgatgaagatcaaggacgaggagcgcgacgacaccctgaccatcctcctgaaggccaccctgctcgccgtgagcggcgtctaccccctgtccatccccgccaccctgttcgtgtggtacttctggcagaagaagaagcagcggagcggggtgctctgggacacgccctccccgcccgaggtcgagcgcgccgtgctggacgacggcatctaccggatcatgcagcgcggcctgctggggcggagccaggtgggcgtcggggtgttccaggagaacgtgttccacaccatgtggcacgtcacccgcggcgcggtgctcatgtaccaggggaagcggctggagccctcctgggccagcgtgaagaaggacctgatctcctacggcggcgggtggcgcctccagggcagctggaacaccggggaggaggtccaggtgatcgccgtggagcccggcaagaacccgaagaacgtccagacggcccccgggaccttcaagacccccgagggcgaggtgggcgccatcgcgctggacttcaagcccgggacctccggcagcccgatcgtgaaccgggaggggaagatcgtcggcctgtacggcaacggggtggtgacgacctccggcacctacgtcagcgccatcgcccaggccaaggcgagccaggaggggcccctccccgagatcgaggacgaggtgttccgcaagcggaacctgaccatcatggacctgcacccgggctccgggaagacgcgccggtacctccccgccatcgtgcgcgaggccatcaagcgcaagctgcggaccctgatcctcgcccccacccgcgtcgtggccagcgagatggcggaggccctgaagggcatgcccatccggtaccagaccacggccgtgaagtccgagcacaccggcaaggagatcgtcgacctgatgtgccacgccaccttcaccatgcgcctcctgagcccggtgcgggtgcccaactacaacatgatcatcatggacgaggcccacttcacggacccctccagcatcgcggcccgcgggtacatctccacccgggtcggcatgggggaggccgccgccatcttcatgaccgcgacgccgcccggcagcgtggaggccttcccccagtccaacgccgtgatccaggacgaggagcgcgacatccccgagcggagctggaactccgggtacgagtggatcacggacttccccggcaagaccgtctggttcgtgcccagcatcaagtccggcaacgacatcgccaactgcctgcgcaagaacgggaagcgggtgatccagctcagccgcaagaccttcgacaccgagtaccagaagacgaagaacaacgactgggactacgtcgtgaccaccgacatctccgagatgggcgcgaacttccgggccgaccgcgtgatcgacccccggcgctgcctgaagcccgtcatcctgaaggacgggcccgagcgggtgatcctcgccggcccgatgcccgtcaccgtggccagcgccgcgcagcgccgggggcgcatcggccgcaaccacaacaaggagggcgaccagtacatctacatggggcagcccctgaacaacgacgaggaccacgcccactggacggaggccaagatgctgctcgacaacatcaacacccccgagggcatcatcccggccctgttcgagcccgagcgggagaagtccgccgcgatcgacggggagtaccgcctgcggggcgaggcccgcaagaccttcgtggagctcatgcggcgcggggacctgcccgtctggctgagctacaaggtggcctccgagggcttccagtacagcgaccggcgctggtgcttcgacggcgagcggaacaaccaggtgctcgaggagaacatggacgtcgagatctggaccaaggagggggagcgcaagaagctgcggccccgctggctggacgcccggacgtacagcgacccgctcgccctgcgcgagttcaaggagttcgcggccggccggcgctccgtgagcggggacctgatcctcgagatcggcaagctgccccagcacctgacccagcgggcccagaacgccctcgacaacctggtgatgctgcacaactccgagcagggcgggcgcgcgtaccggcacgccatggaggagctccccgacaccatcgagaccctgatgctgctcgccctgatcgccgtcctgacgggcggggtgaccctcttcttcctgagcggccgcgggctgggcaagacctccatcggcctcctgtgcgtgatggccagctccgtcctgctctggatggcgagcgtggagccccactggatcgccgcctccatcatcctggagttcttcctgatggtgctcctgatcccggagcccgaccggcagcgcacgccccaggacaaccagctggcctacgtcgtgatcgggctcctgttcatgatcctgaccgtggccgcgaacgagatgggcctcctggagacgaccaagaaggacctggggatcggccacgtcgccgtggggaaccaccaccacgccgccatgctcgacgtggacctgcacccggccagcgcgtggaccctgtacgccgtcgccaccacgatcatcacccccatgatgcgccacaccatcgagaacaccacggccaacatctccctcaccgccatcgcgaaccaggccgccatcctgatgggcctggacaagggctggcccatcagcaagatggacatcggggtgcccctcctggccctgggctgctactcccaggtgaacccgctcaccctgaccgcggccgtcctgatgctcgtggcccactacgccatcatcgggcccggcctgcaggccaaggcgacgcgggaggcccagaagcgcaccgccgccgggatcatgaagaaccccaccgtggacggcatcgtcgccatcgacctggaccccgtggtgtacgacgcgaagttcgagaagcagctcggccagatcatgctgctgatcctctgcaccagccagatcctgctgatgcggacgacctgggccctctgcgagtccatcaccctggccaccgggccgctgacgaccctctgggagggcagccccgggaagttctggaacaccaccatcgccgtctccatggccaacatcttccgcggcagctacctggcgggcgccgggctggccttctccctcatgaagtccctgggcgggggccggcgcgggacgggcgcccagggcgagaccctgggggagaagtggaagcggcagctcaaccagctgagcaagtccgagttcaacacctacaagcgcagcggcatcatggaggtggaccggtccgaggcgaaggaggggctgaagcgcggcgagatcaccaagcacgccgtgagccgggggacggccaagctccgctggttcgtcgagcggaacctggtgaagcccgagggcaaggtgatcgacctgggctgcgggcgcggcgggtggtcctactactgcgccggcctgaagaaggtcaccgaggtgaaggggtacaccaagggcggccccgggcacgaggagccgatccccatggccacctacggctggaacctcgtgaagctgcacagcgggaaggacgtcttcttcgtgccgcccgagaagtgcgacacgctgctctgcgacatcggcgagtccagcccgaaccccaccatcgaggaggggcggaccctgcgcgtgctgaagatggtcgagccctggctccggggcaaccagttctgcatcaagatcctgaacccctacatgccgtccgtggtggagaccctggagcagatgcagcgcaagcacggcgggatgctcgtccggaaccccctgagccgcaactccacgcacgagatgtactgggtgagctgcggcaccgggaacatcgtgtccgcggtcaacatgaccagccgcatgctgctcaaccggttcaccatggcccaccgcaagcccacctacgagcgggacgtggacctgggcgccggcacgcgccacgtggccgtcgagcccgaggtggccaacctggacatcatcgggcagcggatcgagaacatcaagcacgagcacaagtccacctggcactacgacgaggacaacccgtacaagacctgggcgtaccacggcagctacgaggtcaagccctccgggagcgcctccagcatggtgaacggcgtggtcaagctcctgaccaagccctgggacgtgatccccatggtgacgcagatcgccatgaccgacaccaccccgttcgggcagcagcgcgtcttcaaggagaaggtggacacgcggacccccaaggccaagcgcggcaccgcccagatcatggaggtgaccgcgaagtggctgtggggcttcctcagccggaacaagaagccccgcatctgcacgcgggaggagttcacccgcaaggtccggtccaacgccgccatcggggccgtgttcgtggacgagaaccagtggaacagcgcgaaggaggccgtcgaggacgagcgcttctgggacctggtgcaccgggagcgcgagctgcacaagcagggcaagtgcgcgacctgcgtgtacaacatgatggggaagcgggagaagaagctcggcgagttcgggaaggccaagggctcccgcgccatctggtacatgtggctgggcgcgcggttcctggagttcgaggccctcgggttcatgaacgaggaccactggttcagccgcgagaactccctgagcggcgtcgagggggagggcctgcacaagctcgggtacatcctgcgggacatctccaagatcccgggcggcaacatgtacgccgacgacaccgccgggtgggacacgcgcatcaccgaggacgacctgcagaacgaggcccgcatcaccgacatcatggagcccgagcacgcgctcctggccaagagcatcttcaagctgacctaccagaacaaggtggtgcgggtccagcgccccgccaagaacggcacggtgatggacgtgatctcccggcgcgaccagcgggggagcggccaggtcggcacctacgggctcaacaccttcaccaacatggaggcccagctgatccgccagatggagtccgagggcatcttcagcccctccgagctggagacgccgaacctcgccgagcgggtgctggactggctggagaagtacggggtggagcgcctcaagcggatggcgatcagcggcgacgactgcgtcgtgaagcccatcgacgaccgcttcgccaccgccctgaccgccctgaacgacatggggaaggtgcggaaggacatcccccagtgggagccctccaagggctggaacgactggcagcaggtcccgttctgcagccaccacttccaccagctcatcatgaaggacggccgcgagatcgtggtgccctgccggaaccaggacgagctggtcgggcgcgcccgggtgtcccagggcgcggggtggagcctgcgcgagaccgcctgcctcggcaagagctacgcccagatgtggcagctgatgtacttccaccggcgcgacctgcggctcgccgcgaacgccatctgctccgccgtgcccgtcgactggatccccacgagccgcaccacctggtccatccacgcccaccaccagtggatgaccacggaggacatgctgagcgtgtggaaccgcgtgtggatcgaggagaacccgtggatggaggacaagacccacatctccagctggggcgacgtcccctacctgggcaagcgggaggaccagtggtgcggctccctcatcgggctgaccgcccgcgcgacctgggccacgaacatccaggtggccatcaaccaggtgcggcgcctgatcggcaacgagaactacctcgactacatgaccagcatgaagcggttcaagaacgagtccgaccccgagggggccctgtggtga

SEQ ID NO: 8033 - RNA, 9879 nt, synthetic construct
  misc_feature 1..9879: note = derived and/or modified CDS sequence (opt1) from DENV-1__FJ639691__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccggatcagcgaggccgagcccgacgacgtggactgctggtgcaacgccaccgacacctgggtgacctacgggacctgctcccagaccggcgagcaccggcgcgacaagcggagcgtggccctggcgccccacgtgggcctcgggctggagacccggacggagacctggatgtccagcgagggcgcctggaagcagatccagcgggtcgagacctgggccctgcgccaccccgggttcaccgtgatcgccctcttcctggcgcacgccatcggcacgtccatcacccagaaggggatcatcttcatcctgctcatgctggtgacccccagcatggccatgcggtgcgtcggcatcggctcccgcgacttcgtggaggggctgagcggcgccacctgggtggacgtcgtgctcgagcacgggtcctgcgtgacgaccatggccaaggacaagcccaccctggacatcgagctgctcaagaccgaggtcacgaaccccgcggtgctgcggaagctgtgcatcgaggccaagatcagcaacaccaccaccgactcccgctgcccgacgcagggcgaggccaccctcgtggaggagcaggacgccaacttcgtctgccggcgcaccttcgtggaccggggctgggggaacggctgcgggctgttcggcaaggggagcctgatcacgtgcgccaagttcaagtgcgtgacgaagctcgagggcaagatcgtccagtacgagaacctgaagtactccgtgatcgtgaccgtccacaccggcgaccagcaccaggtggggaacgagagcaccgagcacggcacgaccgcgaccatcacgccccaggccccctccaccgagatccagctgacggactacggggccctcaccctggactgcagcccccgcaccggcctggacttcaacgagatggtcctcctgaccatgaaggagaagtcctggctggtgcacaagcagtggttcctcgacctgccgctgccctggacgtccggggccagcacctcccaggagacctggaaccggcaggacctcctggtgaccttcaagacggcccacgcgaagaagcaggaggtcgtggtgctgggcagccaggagggcgccatgcacaccgccctcaccggggccaccgagatccagacgtccggcaccaccaccatcttcgccgggcacctgaagtgccgcctgaagatggacaagctcacgctgaagggcatgagctacgtcatgtgcaccgggtccttcaagctggagaaggaggtggcggagacccagcacggcaccgtgctcgtccagatcaagtacgagggcacggacgccccctgcaagatccccttcagcacccaggacgagaagggggtgacccagaacggccggctgatcaccgccaacccgatcgtgacggacaaggagaagcccgtcaacatcgaggccgagccgcccttcggggagtcctacatcgtgatcggcgcgggcgagaaggccctgaagctgagctggttcaagaaggggtccagcatcggcaagatgttcgaggccaccgcccgcggggcccggcgcatggcgatcctcggcgacaccgcctgggacttcgggtccatcggcggcgtgttcaccagcgtcgggaagctggtgcaccagatcttcggcacggcctacggggtgctgttctccggcgtcagctggaccatgaagatcgggatcggcgtgctcctgacctggctgggcctcaactcccgcagcacctccctgagcatgacgtgcatcgccgtggggctggtcaccctctacctgggcgtgatggtgcaggccgacagcgggtgcgtcatcaactggaagggccgggagctgaagtgcgggtccggcatcttcgtgaccaacgaggtgcacacctggacggagcagtacaagttccaggcggacagcccgaagcgcctctccgccgccatcggcaaggcctgggaggagggggtctgcggcatccggagcgccacccgcctggagaacatcatgtggaagcagatctccaacgagctgaaccacatcctcctggagaacgacatgaagttcaccgtggtggtcggggacgtggcgggcatcctggcccaggggaagaagatgatccggccccagcccatggagtacaagtacagctggaagtcctggggcaaggccaagatcatcggcgccgacgtgcagaacaccaccttcatcatcgacgggcccaacacgccggagtgccccgacgaccagcgcgcgtggaacatctgggaggtcgaggactacggcttcgggatcttcaccaccaacatctggctcaagctgcgggacagctacacccaggtgtgcgaccaccgcctgatgtccgccgccatcaaggacagcaaggccgtgcacgccgacatgggctactggatcgagtccgagaagaacgagacgtggaagctcgcgcgggccagcttcatcgaggtcaagacctgcatctggcccaagtcccacaccctgtggagcaacggcgtgctggagtccgagatgatcatccccaagatctacgggggcccgatcagccagcacaactaccgccccgggtacttcacccagacggccggcccctggcacctcgggaagctggagctggacttcgacctctgcgagggcaccaccgtggtcgtggacgagcactgcggcaaccgggggccgtccctgcgcaccacgaccgtgaccggcaagatcatccacgagtggtgctgccggagctgcaccctgccgcccctgcgcttcaagggggaggacggctgctggtacgggatggagatccggcccgtcaaggagaaggaggagaacctggtcaagagcatggtgtccgccggcagcggcgaggtcgactccttcagcctggggctcctgtgcatctccatcatgatcgaggaggtgatgcgcagccggtggtcccgcaagatgctgatgacgggcaccctcgccgtgttcttcctgctgatcatggggcagctcacctggaacgacctgatccggctgtgcatcatggtcggcgcgaacgccagcgaccgcatggggatgggcatgacctacctcgccctgatggccacgttcaagatgcgcccgatgttcgccgtgggcctcctgttccggcgcctgacctcccgggaggtgctgctcctgaccatcgggctgagcctcgtcgcgtccgtggagctgcccaacagcctggaggagctcggcgacgggctggccatgggcatcatgatcctgaagctcctgaccgacttccagtcctaccagctgtgggccacgctcctgagcctgaccttcatcaagaccaccttctccctccactacgcctggaagacgatggcgatggtcctgagcatcgtgtccctgttccccctctgcctgagcaccacctcccagaagaccacgtggctgcccgtgctcctgggcagcctggggtgcaagccgctcaccatgttcctgatcgccgagaacaagatctggggccgcaagagctggcccctgaacgaggggatcatggccgtcggcatcgtgtccatcctcctgagctccctgctcaagaacgacgtgcccctggccgggcccctgatcgccggcggcatgctcatcgcgtgctacgtcatcagcgggtccagcgccgacctgtccctggagaaggccgccgaggtgagctgggaggaggaggccgagcactccggcgcgagccacaacatcctcgtggaggtccaggacgacgggaccatgaagatcaaggacgaggagcgggacgacaccctgacgatcctgctcaaggccaccctgctggccgtgtccggcgtgtacccgctcagcatccccgccaccctgttcgtctggtacttctggcagaagaagaagcagcgctccggggtgctgtgggacacccccagcccgcccgaggtggagcgggccgtcctcgacgacggcatctaccgcatcatgcagcggggcctgctggggcgctcccaggtgggcgtgggggtcttccaggagaacgtgttccacaccatgtggcacgtgacgcggggcgcggtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagaccgcccccgggaccttcaagacgagcgagggcgaggtcggcgccatcgcgctcgacttcaagcccgggaccagcggctcccccatcgtgaaccgcgaggggaagatcgtgggcctgtacggcaacggggtcgtgaccaccagcggcacgtacgtgtccgccatcgcccaggccaaggcgagccaggaggggcccctgccggagatcgaggacgaggtcttccggaagcgcaacctcaccatcatggacctgcaccccggctccgggaagacccggcgctacctgcccgccatcgtgcgggaggccatcaagcgcaagctccggaccctgatcctggccccgacgcgcgtggtcgccagcgagatggcggaggccctcaagggcatgcccatccgctaccagaccaccgccgtgaagtccgagcacaccggcaaggagatcgtggacctgatgtgccacgccacgttcaccatgcggctgctcagccccgtccgcgtgcccaactacaacatgatcatcatggacgaggcccacttcaccgacccgtccagcatcgcggcccgggggtacatctccacccgcgtgggcatgggggaggccgccgccatcttcatgacggcgacgccgcccggcagcgtcgaggccttcccccagtccaacgccgtgatccaggacgaggagcgggacatcccggagcgcagctggaactccgggtacgagtggatcaccgacttccccggcaagaccgtgtggttcgtccccagcatcaagtccggcaacgacatcgccaactgcctgcggaagaacgggaagcgcgtgatccagctgagccggaagacgttcgacaccgagtaccagaagaccaagaacaacgactgggactacgtggtcaccacggacatctccgagatgggcgcgaacttccgcgccgaccgggtgatcgacccccgccggtgcctcaagccggtgatcctgaaggacgggcccgagcgcgtcatcctggccggccccatgcccgtgaccgtcgccagcgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagacgttcgtggagctgatgcgccgcggggacctcccggtgtggctgtcctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcccgcacctacagcgaccccctggccctccgggagttcaaggagttcgcggccggccgccggtccgtcagcggggacctgatcctggagatcggcaagctcccccagcacctgacccagcgcgcccagaacgccctggacaacctcgtgatgctgcacaactccgagcagggcgggcgggcgtaccgccacgccatggaggagctgccggacacgatcgagaccctcatgctgctggccctcatcgccgtgctgaccggcggggtcaccctgttcttcctcagcggccgggggctgggcaagacgtccatcggcctgctctgcgtgatggccagctccgtgctgctgtggatggcgagcgtcgagccccactggatcgccgcctccatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagaccaccaagaaggacctggggatcggccacgtggccgtcgagaaccaccaccacgccgccatgctggacgtggacctccaccccgccagcgcgtggacgctgtacgccgtggccaccaccatcatcacccccatgatgcgccacacgatcgagaacaccaccgccaacatctccctgaccgccatcgcgaaccaggccgccatcctcatggggctggacaagggctggccgatcagcaagatggacatcggcgtccccctgctcgccctggggtgctactcccaggtgaaccccctgacgctcaccgcggccgtgctgatgctggtcgcccactacgccatcatcggccccgggctccaggccaaggcgacccgggaggcccagaagcgcaccgccgccggcatcatgaagaacccgacggtggacgggatcgtggccatcgacctggaccccgtcgtgtacgacgcgaagttcgagaagcagctgggccagatcatgctcctgatcctgtgcaccagccagatcctcctgatgcgcaccacctgggccctgtgcgagtccatcacgctcgccaccggccccctgaccaccctgtgggaggggagccccggcaagttctggaacacgaccatcgccgtgagcatggccaacatcttccgggggtcctacctcgcgggcgccggcctggccttcagcctgatgaagtccctcgggggcgggcgccggggcaccggggcccagggcgagaccctgggcgagaagtggaagcgccagctgaaccagctcagcaagtccgagttcaacacgtacaagcggagcgggatcatggaggtcgaccgctccgaggcgaaggagggcctgaagcgcggggagaccaccaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgacggaggtcaaggggtacaccaagggcgggcccggccacgaggagcccatccccatggccacctacgggtggaacctggtgaagctccacagcggcaaggacgtgttcttcgtcccgcccgagaagtgcgacaccctgctgtgcgacatcggggagtccagccccaaccccacgatcgaggagggccgcaccctccgggtgctgaagatggtggagccgtggctgcgcgggaaccagttctgcatcaagatcctcaacccctacatgccctccgtcgtggagaccctggagcagatgcagcggaagcacggcggcatgctggtgcgcaaccccctcagccggaactccacccacgagatgtactgggtcagctgcgggacgggcaacatcgtgtccgcggtgaacatgaccagccgcatgctgctgaaccggttcaccatggcccaccgcaagccgacctacgagcgcgacgtcgacctcggggccggcacccggcacgtggccgtggagcccgaggtcgccaacctggacatcatcggccagcgcatcgagaacatcaagcacgagcacaagtccacgtggcactacgacgaggacaacccctacaagacctgggcgtaccacgggagctacgaggtgaagcccagcggctccgccagctccatggtcaacggggtggtgaagctgctcaccaagccgtgggacgtcatccccatggtgacccagatcgccatgacggacaccacccccttcggccagcagcgggtgttcaaggagaaggtcgacacccgcacgcccaaggccaagcgggggaccgcccagatcatggaggtgaccgcgaagtggctgtggggcttcctgagccgcaacaagaagccgcggatctgcacccgcgaggagttcacgcggaaggtgcgctccaacgccgccatcggcgccgtcttcgtggacgagaaccagtggaacagcgcgaaggaggccgtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggtcccgggccatctggtacatgtggctcggcgcgcgcttcctggagttcgaggccctgggcttcatgaacgaggaccactggttcagccgggagaactccctcagcggggtggagggcgaggggctgcacaagctgggctacatcctccgcgacatctccaagatcagcgggggcaacatgtacgccgacgacaccgccggctgggacacccggatcacggaggacgacctgcagaacgaggccaagatcaccgacatcatggagcccgagcacgcgctgctcgccaagtccatcttcaagctgacctaccagaacaaggtcgtgcgcgtgcagcggcccgccaagaacgggaccgtcatggacgtgatcagccgccgcgaccagcggggctccggccaggtgggcacgtacggcctgaacaccttcaccaacatggaggcccagctcatccgccagatggagagcgaggggatcttctccccgagcgagctggagacccccaacctggccgagcggacgctcgactggctggagaagcacggcgtcgagcgcctgaagcggatggcgatcagcggggacgactgcgtggtgaagcccatcgacgaccgcttcgccaccgccctcaccgccctgaacgacatgggcaaggtccggaaggacatcccccagtgggagccgtccaaggggtggaacgactggcagcaggtccccttctgcagccaccacttccaccagctgatcatgaaggacggccgcgagatcgtggtcccctgccggaaccaggacgagctcgtgggccgcgcccgggtgtcccagggggcgggctggagcctgcgcgagaccgcctgcctggggaagtcctacgcccagatgtggcagctcatgtacttccaccggcgcgacctgcggctggccgcgaacgccatctgcagcgccgtccccgtggactgggtgccgacgtcccgcaccacctggagcatccacgcccaccaccagtggatgaccacggaggacatgctctccgtctggaaccgggtgtggatcgaggagaacccctggatggaggacaagacccacatcagctcctgggaggacgtgccctacctgggcaagcgcgaggaccagtggtgcgggagcctgatcggcctcaccgcccgggcgacctgggccacgaacatccaggtcgccatcaaccaggtgcgccgcctgatcggcaacgagaactacctggactacatgacctccatgaagcggttcaagaacgagagcgacctcgagggggccctgtggtga

SEQ ID NO: 8034 - RNA, 9879 nt, synthetic construct
  misc_feature 1..9879: note = derived and/or modified CDS sequence (opt1) from DENV-1__FJ639692__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctcgcgccccacgtgggcctggggctggagacgcgcaccgagacctggatgagctccgagagcgcctggaagcagatccagcgggtggagacctgggccctccgccaccccggcttcacggtgatcgccctgttcctggcgcacgccatcgggacctccatcacccagaagggcatcatcttcatcctcctgatgctggtgacccccagcatggccatgcggtgcgtcgggatcggctcccgcgacttcgtggagggcctcagcggggccacgtgggtggacgtcgtgctggagcacggctcctgcgtgaccaccatggccaaggacaagcccaccctggacatcgagctcctgaagacggaggtcaccaaccccgcgatcctgcggaagctctgcatcgaggccaagatcagcaacaccaccacggactcccgctgcccgacccagggggaggccaccctggtggaggagcaggacgccaacttcgtgtgccggcgcaccttcgtcgaccggggctggggcaacgggtgcggcctgttcgggaagggcagcctcatcacgtgcgccaagttcaagtgcgtgaccaagctggaggggaagatcgtgcagtacgagaacctgaagtactccgtcatcgtgaccgtgcacaccggcgaccagcaccaggtcggcaacgagagcacggagcacgggaccaccgcgaccatcacgccccaggcccccacgaccgagatccagctcaccgactacggcgccctgaccctggactgcagcccccggacggggctcgacttcaacgagatggtgctgctgaccatgaaggagaagtcctggctcgtccacaagcagtggttcctggacctgcccctcccctggaccagcggcgcctccaccagccaggagacgtggaaccggcaggacctgctggtgaccttcaagaccgcccacgcgaagaagcaggaggtggtcgtgctcgggtcccaggagggcgccatgcacaccgccctgacgggcgccaccgagatccagaccagcgggaccacgaccatcttcgccggccacctgaagtgccgcctcaagatggacaagctgaccctgaaggggatgtcctacgtgatgtgcaccggcagcttcaagctcgagaaggaggtcgcggagacgcagcacgggaccgtgctggtgcagatcaagtacgagggcaccgacgccccctgcaagatccccttctccacccaggacgagaagggcgtcacgcagaacgggcggctgatcaccgccaacccgatcgtgaccgacaaggagaagcccgtgaacatcgaggccgagccgcccttcggcgagagctacatcgtcatcggggcgggcgagaaggccctgaagctctcctggttcaagaagggcagctccatcgggaagatgttcgaggccaccgcccgcggcgcccggcgcatggcgatcctgggggacacggcctgggacttcggcagcatcgggggcgtgttcacctccgtgggcaagctggtccaccagatcttcgggaccgcctacggcgtcctgttcagcggggtgtcctggaccatgaagatcggcatcggggtcctgctgacgtggctcggcctgaacagccgctccaccagcctgtccatgacctgcatcgccgtgggcctcgtgaccctgtacctgggggtcatggtgcaggccgacagcggctgcgtgatcaactggaaggggcgggagctcaagtgcggcagcgggatcttcgtcacgaacgaggtgcacacctggaccgagcagtacaagttccaggcggactccccgaagcgcctgagcgccgccatcggcaaggcctgggaggagggcgtgtgcgggatccggtccgccacccgcctggagaacatcatgtggaagcagatcagcaacgagctcaaccacatcctgctggagaacgacatgaagttcaccgtcgtggtgggcgacgtcgcggggatcctcgcccagggcaagaagatgatccggccccagcccatggagtacaagtactcctggaagtcctgggggaaggccaagatcatcggcgccgacgtgcagaacacgaccttcatcatcgacggccccaacaccccggagtgccccgacgaccagcgcgcgtggaacatctgggaggtggaggactacgggttcggcatcttcaccacgaacatctggctgaagctgcgggactcctacacccaggtctgcgaccaccgcctcatgagcgccgccatcaaggactccaaggccgtgcacgccgacatggggtactggatcgagagcgagaagaacgagacctggaagctggcgcgggcctccttcatcgaggtgaagacctgcatctggcccaagagccacacgctgtggtccaacggcgtcctcgagagcgagatgatcatccccaagatctacggcgggccgatctcccagcacaactaccgccccggctacttcacccagaccgccgggccctggcacctgggcaagctggagctcgacttcgacctgtgcgaggggaccacggtggtggtcgacgagcactgcggcaaccggggcccgagcctgcgcaccaccaccgtgacggggaagatcatccacgagtggtgctgccggtcctgcaccctgccgcccctccgcttccggggcgaggacgggtgctggtacggcatggagatccgccccgtgaaggagaaggaggagaacctggtcaagagcatggtgagcgccgggtccggcgaggtggacagcttctccctcggcctgctgtgcatcagcatcatgatcgaggaggtcatgcggtcccgctggagccggaagatgctcatgaccgggaccctggccgtgttcctgctcctgatcatgggccagctgacgtggaacgacctcatccgcctgtgcatcatggtgggggcgaacgcctccgaccgcatgggcatggggaccacctacctggccctcatggccaccttcaagatgcggccgatgttcgccgtcgggctgctgttccgccggctcacgagccgcgaggtgctgctgctcaccatcggcctgtccctggtggcgagcgtcgagctccccaactccctggaggagctgggggacggcctcgccatggggatcatgatcctgaagctgctcaccgacttccagagccaccagctgtgggccaccctgctctccctgacgttcatcaagaccaccttcagcctgcactacgcctggaagaccatggcgatggtgctctccatcgtcagcctgttccccctgtgcctctccacgaccagccagaagaccacctggctgcccgtgctgctcggctccctgggctgcaagccgctgacgatgttcctcatcgccgagaacaagatctgggggcggcgcagctggcccctgaacgagggcatcatggccgtggggatcgtcagcatcctgctctccagcctgctgaagaacgacgtgcccctcgccggccccctgatcgccgggggcatgctgatcgcgtgctacgtgatctccggcagctccgccgacctcagcctggagaaggccgccgaggtctcctgggaggaggaggccgagcacagcggggcgtcccacaacatcctggtggaggtgcaggacgacggcaccatgaagatcaaggacgaggagcgggacgacaccctcaccatcctgctgaaggccaccctcctggccgtcagcggggtgtacccgctgtccatccccgccaccctcttcgtgtggtacttctggcagaagaagaagcagcgcagcggcgtcctgtgggacacccccagcccgcccgaggtggagcgggccgtgctggacgacgggatctaccgcatcatgcagcggggcctgctcggccgcagccaggtcggggtgggcgtgttccaggagaacgtcttccacaccatgtggcacgtgacccgcggggccgtgctgatgtaccagggcaagcgcctggagccctcctgggccagcgtcaagaaggacctcatctcctacgggggcggctggcggctgcaggggagctggaacacgggcgaggaggtccaggtgatcgccgtcgagcccgggaagaaccccaagaacgtgcagaccgcccccggcaccttcaagacccccgagggggaggtgggcgccatcgcgctggacttcaagcccggcacgtccgggagccccatcgtcaaccgcgagggcaagatcgtggggctctacggcaacggcgtggtcaccaccagcgggacctacgtgtccgccatcgcccaggccaaggcgagccaggagggcccgctgcccgagatcgaggacgaggtgttccggaagcgcaacctgacgatcatggacctccaccccgggtccggcaagacccggcgctacctgccggccatcgtccgggaggccatcaagcgcaagctgcgcaccctcatcctggcccccacccgggtggtggccagcgagatggcggaggccctgaaggggatgcccatccgctaccagacgaccgccgtcaagtccgagcacaccggcaaggagatcgtggacctcatgtgccacgccaccttcacgatgcggctgctgagccccgtgcgcgtcccgaactacaacatgatcatcatggacgaggcccacttcaccgacccctccagcatcgcggcccggggctacatctccacccgcgtggggatgggcgaggccgccgccatcttcatgaccgcgacgccgcccgggagcgtggaggccttcccgcagtccaacgccctcatccaggacgaggagcgggacatccccgagcgcagctggaactccggctacgagtggatcaccgacttccccgggaagaccgtctggttcgtgcccagcatcaagtccggcaacgacatcgccaactgcctgcggaagaacggcaagcgcgtgatccagctgagccggaagaccttcgacacggagtaccagaagaccaagaacaacgactgggactacgtcgtgaccaccgacatctccgagatgggggcgaacttccgcgccgaccgggtgatcgacccgcgccggtgcctcaagcccgtcatcctgaaggacggccccgagcgcgtgatcctggccgggcccatgccggtgacggtcgccagcgccgcgcagcggcgcggccggatcgggcgcaaccacaacaaggagggcgaccagtacatctacatgggccagcccctcaacaacgacgaggaccacgcccactggaccgaggccaagatgctgctggacaacatcaacacccccgaggggatcatccccgccctcttcgagccggagcgcgagaagtccgccgcgatcgacggcgagtaccggctgcgcggggaggcccggaagaccttcgtggagctgatgcgccggggcgacctccccgtctggctgagctacaaggtggccagcgaggggttccagtactccgaccgccggtggtgcttcgacggcgagcgcaacaaccaggtgctggaggagaacatggacgtcgagatctggacgaaggagggcgagcggaagaagctccgcccccggtggctggacgcccgcacctacagcgaccccctggccctccgggagttcaaggagttcgcggccgggcgccggtccgtgagcggcgacctgatcctggagatcgggaagctcccgcagcacctgacccagcgcgcccagaacgccctggacaacctcgtgatgctgcacaactccgagcagggcggccgggcgtaccgccacgccatggaggagctgcccgacaccatcgagacgctcatgctgctggccctcatcgccgtcctgaccgggggcgtgaccctgttcttcctcagcgggcggggcctggggaagacctccatcggcctgctctgcgtgatggccagctccgtcctgctgtggatggcgagcgtggagccccactggatcgccgcctccatcatcctcgagttcttcctgatggtgctgctcatccccgagccggaccgccagcggacgccccaggacaaccagctggcctacgtcgtgatcggcctcctcttcatgatcctgacggtggccgcgaacgagatggggctgctcgagaccaccaagaaggacctgggcatcgggcacgtcgccgtgggcaaccaccaccacgccgccatgctggacgtggacctccaccccgccagcgcgtggaccctgtacgccgtcgccacgaccatcatcaccccgatgatgcgccacaccatcgagaacacgaccgccaacatctccctgaccgccatcgcgaaccaggccgccatcctcatggggctggacaagggctggcccatcagcaagatggacatcggcgtgcccctgctcgccctggggtgctactcccaggtgaaccccctgaccctcacggcggccgtcctgatgctggtggcccactacgccatcatcggcccggggctccaggccaaggcgacccgcgaggcccagaagcggaccgccgccggcatcatgaagaaccccaccgtggacgggatcgtcgccatcgacctggaccccgtggtgtacgacgcgaagttcgagaagcagctgggccagatcatgctcctgatcctgtgcacgagccagatcctcctgatgcgcaccacctgggccctgtgcgagtccatcaccctcgccacgggccccctgaccaccctgtgggaggggagcccgggcaagttctggaacaccacgatcgccgtctccatggccaacatcttccgggggagctacctcgcgggcgccggcctggccttcagcctgatgaagtccctcgggggcgggcgccggggcaccggggcccagggcgagaccctgggcgagaagtggaagcgccagctgaaccagctcagcaagtccgagttcaacacctacaagcggagcgggatcacggaggtggaccgctccgaggcgaaggagggcctgaagcgcggggagaccaccaagcacgccgtgagccgcggcaccgccaagctgcggtggttcgtcgagcgcaacctggtgaagcccgaggggaaggtgatcgacctcggctgcggccgcggcgggtggtcctactactgcgccgggctgaagaaggtcacggaggtgaaggggtacaccaagggcgggcccggccacgaggagcccatcccgatggccacctacgggtggaacctggtgaagctccacagcggcaaggacgtcttcttcatcccgcccgagaagtgcgacaccctgctgtgcgacatcggggagtccagccccaacccgacgatcgaggagggccgcaccctccgggtgctgaagatggtggagccctggctgcgcgggaaccagttctgcatcaagatcctcaacccctacatgccctccgtcgtggagaccctggagcagatgcagcggaagcacggcggcatgctggtgcgcaacccgctcagccggaactccacccacgagatgtactgggtcagctgcgggaccggcaacatcgtgtccgcggtgaacatgacgagccgcatgctgctgaaccgcttcaccatggcccaccggaagcccacctacgagcgcgacgtcgacctcggggccggcacccggcacgtggccgtggagcccgaggtcgccaacctggacatcatcggccagcgcatcgagaacatcaagcacgagcacaagtccacgtggcactacgacgaggacaacccctacaagacctgggcgtaccacgggagctacgaggtgaagccgtccggcagcgccagctccatggtgaacggggtcgtgaagctgctcaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgcgaagtggctgtggggcttcctgagccgcaacaagaagccccggatctgcacccgcgaggagttcacgcggaaggtgcgctccaacgccgccatcggcgccgtcttcgtggacgagaaccagtggaacagcgcgaaggaggccgtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggtcccgggccatctggtacatgtggctcggcgcgcgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacaccgccggctgggacacccggatcacggaggacgacctgcagaacgaggcccgcatcaccgacatcatggagccggagcacgcgctgctcgccaagagcatcttcaagctgacctaccagaacaaggtcgtgcgcgtgcagcggcccgccaagaacgggaccgtcatggacgtgatctcccgccgggaccagcgcggcagcggccaggtgggcacgtacggcctgaacaccttcaccaacatggaggcccagctcatccggcagatggagtccgaggggatcttcagcccctccgagctggagacccccaacctggccgagcgcgtcctcgactggctggagaagtacggcgtggagcggctgaagcgcatggcgatcagcggggacgactgcgtggtcaagccgatcgacgaccggttcgccacggccctcaccgccctgaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctcgtgggccgggcccgcgtcagccagggggcgggctggtccctgcgggagaccgcctgcctgggcaagagctacgcccagatgtggcagctcatgtacttccaccgccgggacctgcgcctggccgcgaacgccatctgctccgccgtgcccgtggactggatccccaccagccggacgacctggtccatccacgcccaccaccagtggatgaccaccgaggacatgctcagcgtctggaaccgcgtgtggatcgaggagaacccctggatggaggacaagacgcacatctccagctggggcgacgtgccgtacctggggaagcgcgaggaccagtggtgcggctccctgatcggcctcaccgcccgggcgacctgggccaccaacatccaggtcgccatcaaccaggtgcgccggctgatcgggaacgagaactacctggactacatgaccagcatgaagcgcttcaagaacgagtccgaccccgagggcgccctctggtga

SEQ ID NO: 8035 - RNA, 9879 nt, synthetic construct
  misc_feature 1..9879: note = derived and/or modified CDS sequence (opt1) from DENV-1__FJ639693__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagttctgcgaggacaccatgacctacaagtgcccccggatcagcgaggccgagcccgacgacgtggactgctggtgcaacgccaccgacacctgggtcacctacgggacctgctcccagaccggcgagcaccggcgcgacaagcggagcgtggccctggcgccccacgtgggcctcgggctggagacccggacggagacctggatgtccagcgagggcgcctggaagcagatccagcgggtcgagacctgggccctgcgccacccggggttcaccgtgatcgccctcttcctggcgcacgccatcggcacgtccatcacccagaaggggatcatcttcatcctgctcatgctggtgacccccagcatggccatgcggtgcgtcggcatcggctcccgcgacttcgtggaggggctgagcggcgccacctgggtggacgtcgtgctcgagcacgggtcctgcgtgacgaccatggccaaggacaagcccaccctggacatcgagctgctcaagaccgaggtcacgaaccccgcggtgctgcggaagctgtgcatcgaggccaagatcagcaacaccaccaccgactcccgctgcccgacgcagggcgaggccaccctcgtggaggagcaggacgccaacttcgtctgccggcgcaccttcgtggaccggggctgggggaacggctgcgggctgttcggcaaggggagcctgatcacgtgcgccaagttcaagtgcgtgacgaagctcgagggcaagatcgtccagtacgagaacctgaagtactccgtgatcgtgaccgtccacaccggcgaccagcaccaggtggggaacgagagcaccgagcacggcacgaccgcgaccatcacgccccaggccccctccaccgagatccagctgacggactacggggccctcaccctggactgcagcccccgcaccggcctggacttcaacgagatggtcctcctgaccatgaaggagaagtcctggctggtgcacaagcagtggttcctcgacctgccgctgccctggacgtccggggccagcacctcccaggagacctggaaccggcaggacctcctggtgaccttcaagacggcccacgcgaagaagcaggaggtcgtggtgctgggcagccaggagggcgccatgcacaccgccctcaccggggccaccgagatccagacgtccggcaccaccaccatcttcgccgggcacctgaagtgccgcctgaagatggacaagctcacgctgaagggcatgagctacgtcatgtgcaccgggtccttcaagctggagaaggaggtggcggagacccagcacggcaccgtgctcgtccagatcaagtacgagggcacggacgccccctgcaagatccccttcagcacccaggacgagaagggggtgacccagaacggccggctgatcaccgccaacccgatcgtgacggacaaggagaagcccgtcaacatcgaggccgagccgcccttcggggagtcctacatcgtgatcggcgcgggcgagaaggccctgaagctgagctggttcaagaaggggtccagcatcggcaagatgttcgaggccaccgcccgcggggcccggcgcatggcgatcctcggcgacaccgcctgggacttcgggtccatcggcggcgtgttcaccagcgtcgggaagctggtgcaccagatcttcggcacggcctacggggtgctgttctccggcgtcagctggaccatgaagatcgggatcggcgtgctcctgacctggctgggcctcaactcccgcagcacctccctgagcatgacgtgcatcgccgtggggctggtcaccctctacctgggcgtgatggtgcaggccgacagcgggtgcgtcatcaactggaagggccgggagctgaagtgcgggtccggcatcttcgtgaccaacgaggtgcacacctggacggagcagtacaagttccaggcggacagcccgaagcgcctctccgccgccatcggcaaggcctgggaggagggggtctgcggcatccggagcgccacccgcctggagaacatcatgtggaagcagatctccaacgagctgaaccacatcctcctggagaacgacatgaagttcaccgtggtggtcggggacgtggcgggcatcctggcccaggggaagaagatgatccggccccagcccatggagtacaagtacagctggaagtcctggggcaaggccaagatcatcggcgccgacgtgcagaacaccaccttcatcatcgacgggcccaacacgccggagtgccccgacgaccagcgcgcgtggaacatctgggaggtcgaggactacggcttcgggatcttcaccaccaacatctggctcaagctgcgggacagctacacccaggtgtgcgaccaccgcctgatgtccgccgccatcaaggacagcaaggccgtgcacgccgacatgggctactggatcgagtccgagaagaacgagacgtggaagctcgcgcgggccagcttcatcgaggtcaagacctgcatctggcccaagtcccacaccctgtggagcaacggcgtgctggagtccgagatgatcatccccaagatctacgggggcccgatcagccagcacaactaccgccccgggtacttcacccagacggccggcccctggcacctcgggaagctggagctggacttcgacctctgcgagggcaccaccgtggtcgtggacgagcactgcggcaaccgggggccgtccctgcgcaccacgaccgtgaccggcaagatcatccacgagtggtgctgccggagctgcaccctgccgcccctgcgcttcaagggggaggacggctgctggtacgggatggagatccggcccgtcaaggagaaggaggagaacctggtcaagagcatggtgtccgccggcagcggcgaggtcgactccttcagcctggggctcctgtgcatctccatcatgatcgaggaggtgatgcgcagccggtggtcccgcaagatgctgatgacgggcaccctcgccgtgttcttcctgctgatcatggggcagctcacctggaacgacctgatccggctgtgcatcatggtcggcgcgaacgccagcgaccgcatggggatgggcatgacctacctcgccctgatggccacgttcaagatgcgcccgatgttcgccgtgggcctcctgttccggcgcctgacctcccgggaggtgctgctcctgaccatcgggctgagcctcgtcgcgtccgtggagctgcccaacagcctggaggagctcggcgacgggctggccatgggcatcatgatcctgaagctcctgaccgacttccagtcccaccagctgtgggccacgctcctgagcctgaccttcatcaagaccaccttctccctccactacgcctggaagacgatggcgatggtcctgagcatcgtgtccctgttccccctctgcctgagcaccacctcccagaagaccacgtggctgcccgtgctcctgggcagcctggggtgcaagccgctcaccatgttcctgatcgccgagaacaagatctggggccgcaagagctggcccctgaacgaggggatcatggccgtcggcatcgtgtccatcctcctgagctccctgctcaagaacgacgtgcccctggccgggcccctgatcgccggcggcatgctcatcgcgtgctacgtcatcagcgggtccagcgccgacctgtccctggagaaggccgccgaggtgagctgggaggaggaggccgagcactccggcgcgagccacaacatcctcgtggaggtccaggacgacgggaccatgaagatcaaggacgaggagcgggacgacaccctgacgatcctgctcaaggccaccctgctggccgtgtccggcgtgtacccgctcagcatccccgccaccctgttcgtctggtacttctggcagaagaagaagcagcgctccggggtgctgtgggacacccccagcccgcccgaggtggagcgggccgtcctcgacgacggcatctaccgcatcatgcagcggggcctgctggggcgctcccaggtgggcgtgggggtcttccaggagaacgtgttccacaccatgtggcacgtgacgcggggcgcggtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagaccgcccccgggaccttcaagacgagcgagggcgaggtcggcgccatcgcgctcgacttcaagcccgggaccagcggctcccccatcgtgaaccgcgaggggaagatcgtgggcctgtacggcaacggggtcgtgaccaccagcggcacgtacgtgtccgccatcgcccaggccaaggcgagccaggaggggcccctgccggagatcgaggacgaggtcttccggaagcgcaacctcaccatcatggacctgcaccccggctccgggaagacccggcgctacctgcccgccatcgtgcgggaggccatcaagcgcaagctccggaccctgatcctggccccgacgcgcgtggtcgccagcgagatggcggaggccctcaagggcatgcccatccgctaccagaccaccgccgtgaagtccgagcacaccggcaaggagatcgtggacctgatgtgccacgccacgttcaccatgcggctgctcagccccgtccgcgtgcccaactacaacatgatcatcatggacgaggcccacttcaccgacccgtccagcatcgcggcccgggggtacatctccacccgcgtgggcatgggggaggccgccgccatcttcatgacggcgacgccgcccggcagcgccgaggccttcccccagtccaacgccgtcatccaggacgaggagcgggacatcccggagcgcagctggaactccgggtacgagtggatcaccgacttccccggcaagaccgtgtggttcgtgcccagcatcaagtccggcaacgacatcgcgaactgcctgcggaagaacgggaagcgcgtcatccagctgagccggaagacgttcgacaccgagtaccagaagaccaagaacaacgactgggactacgtggtgaccacggacatctccgagatgggcgccaacttccgcgccgaccgggtcatcgacccccgccggtgcctcaagccggtgatcctgaaggacgggcccgagcgcgtgatcctggccggccccatgcccgtcaccgtggccagcgcggcccagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgcggccatcgacggggagtaccgcctgcgcggcgaggcccggaagacgttcgtcgagctgatgcgccgcggggacctcccggtgtggctgtcctacaaggtggccagcgagggcttccagtactccgaccgccggtggtgcttcgacggcgagcgcaacaaccaggtcctggaggagaacatggacgtggagatctggaccaaggagggggagcggaagaagctccgcccccggtggctggacgcccgcacctacagcgaccccctggcgctccgggagttcaaggagttcgccgccggccgccggtccgtgagcggggacctgatcctggagatcggcaagctcccccagcacctgacccagcgcgcccagaacgcgctggacaacctcgtcatgctgcacaactccgagcagggcgggcgggcctaccgccacgccatggaggagctgccggacacgatcgagaccctcatgctgctggccctcatcgccgtgctgaccggcggggtgaccctgttcttcctcagcggccgggggctgggcaagacgtccatcggcctgctctgcgtcatggcgagctccgtgctgctgtggatggccagcgtggagccccactggatcgccgcctccatcatcctcgagttcttcctgatggtcctgctcatccccgagcccgaccgccagcggaccccgcaggacaaccagctggcctacgtggtgatcgggctcctgttcatgatcctgaccgtcgcggccaacgagatgggcctgctcgagaccaccaagaaggacctggggatcggccacgtggccgtggagaaccaccaccacgccgccatgctggacgtcgacctccaccccgcgagcgcctggacgctgtacgccgtggccaccaccatcatcacccccatgatgcgccacacgatcgagaacaccaccgccaacatctccctgaccgcgatcgccaaccaggccgccatcctcatggggctggacaagggctggccgatcagcaagatggacatcggcgtgcccctgctcgcgctggggtgctactcccaggtcaaccccctgacgctcaccgccgccgtgctgatgctggtggcccactacgccatcatcggccccgggctccaggcgaaggccacccgggaggcccagaagcgcaccgccgccggcatcatgaagaacccgacggtcgacgggatcgtggcgatcgacctggaccccgtggtctacgacgccaagttcgagaagcagctgggccagatcatgctcctgatcctgtgcaccagccagatcctcctgatgcgcaccacctgggccctgtgcgagtccatcacgctcgccgtgggcttccagaccaccctgtgggaggggagccccggcaagttctggaacaccacgatcgccgtgagcatggcgaacatcttccgggggtcctacctggccggcgccggcctcgccttcagcctgatgaagtccctcgggggcgggcgccgggggaccggggcgcagggcgagaccctcggcgagaagtggaagcgccagctgaaccagctgagcaagtccgagttcaacacctacaagcggagcgggatcatggaggtcgaccgctccgaggccaaggagggcctcaagcgcggggagacgaccaagcacgccgtgagccgcggcaccgccaagctgcggtggttcgtggagcgcaacctggtcaagcccgaggggaaggtgatcgacctcggctgcggccgcggcgggtggtcctactactgcgccgggctgaagaaggtgaccgaggtcaaggggtacacgaagggcggcccgggccacgaggagcccatccccatggcgacctacgggtggaacctggtgaagctgcacagcggcaaggacgtgttcttcgtgccgcccgagaagtgcgacaccctcctgtgcgacatcggggagtccagccccaaccccaccatcgaggagggccgcacgctgcgggtgctcaagatggtggagccctggctgcgcgggaaccagttctgcatcaagatcctgaacccctacatgccctccgtcgtggagaccctcgagcagatgcagcggaagcacggcggcatgctggtgcgcaaccccctgagccggaactccacccacgagatgtactgggtcagctgcgggaccggcaacatcgtgtccgccgtgaacatgacgagccgcatgctcctgaaccggttcaccatggcccaccgcaagcccacctacgagcgcgacgtcgacctgggggccggcacccggcacgtggccgtggagccggaggtcgcgaacctcgacatcatcggccagcgcatcgagaacatcaagcacgagcacaagtccacctggcactacgacgaggacaacccctacaagacgtgggcctaccacgggagctacgaggtgaagcccagcggctccgccagctccatggtcaacggggtggtgaagctgctgaccaagccctgggacgtcatcccgatggtgacccagatcgccatgaccgacacgacccccttcggccagcagcgggtgttcaaggagaaggtcgacacccgcacccccaaggccaagcgggggacggcgcagatcatggaggtgaccgccaagtggctctggggcttcctgagccgcaacaagaagccccggatctgcacccgcgaggagttcacccggaaggtgcgctccaacgccgccatcggcgcggtcttcgtggacgagaaccagtggaacagcgccaaggaggccgtggaggacgagcggttctgggacctggtccaccgcgagcgggagctccacaagcaggggaagtgcgccacgtgcgtgtacaacatgatgggcaagcgcgagaagaagctgggggagttcggcaaggccaaggggtcccgggcgatctggtacatgtggctgggcgcccgcttcctcgagttcgaggccctgggcttcatgaacgaggaccactggttcagccgggagaactccctgagcggggtggagggcgaggggctccacaagctgggctacatcctgcgcgacatctccaagatcagcgggggcaacatgtacgccgacgacaccgccggctgggacacccggatcaccgaggacgacctccagaacgaggcgaagatcacggacatcatggagccggagcacgccctgctggccaagtccatcttcaagctcacctaccagaacaaggtcgtgcgcgtgcagcggcccgccaagaacgggaccgtcatggacgtgatcagccgccgcgaccagcggggctccggccaggtgggcacctacggcctgaacacgttcaccaacatggaggcccagctgatccgccagatggagagcgaggggatcttctcccccagcgagctcgagaccccgaacctggcggagcgggccctggactggctcgagaagcacggcgtcgagcgcctgaagcggatggccatcagcggggacgactgcgtggtgaagcccatcgacgaccgcttcgccaccgccctgacggcgctcaacgacatgggcaaggtccggaaggacatcccccagtgggagccctccaaggggtggaacgactggcagcaggtcccgttctgcagccaccacttccaccagctgatcatgaaggacggccgcgagatcgtggtcccctgccggaaccaggacgagctggtgggccgcgcccgggtgtcccagggggccggctggagcctccgcgagaccgcctgcctggggaagtcctacgcgcagatgtggcagctgatgtacttccaccggcgcgacctccggctggccgccaacgccatctgcagcgccggccccgtcgactgggtgcccacctcccgcaccacgtggagcatccacgcgcaccaccagtggatgaccaccgaggacatgctgtccgtgtggaaccgggtctggatcgaggagaacccgtggatggaggacaagacccacatcagctcctgggaggacgtgccctacctcgggaagcgcgaggaccagtggtgcggcagcctgatcggcctgacggcccgggccacctgggccaccaacatccaggtggccatcaaccaggtccgccgcctcatcgggaacgagaactacctggactacatgacctccatgaagcggttcaagaacgagagcgaccccgagggcgcgctgtggtga

SEQ ID NO: 8036 - RNA, 9879 nt, synthetic construct
  misc_feature 1..9879: note = derived and/or modified CDS sequence (opt1) from DENV-1__FJ639694__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgccccacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccttcagcatgacctgcatcgccgtggggctggtgaccctctacctgggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctctccgccgccatcggcaaggcctgggaggagggggtgtgcggcatccggagcgccacccgcctggagaacatcatgtggaagcagatctccaacgagctgaaccacatcctcctggagaacgacatgaagttcaccgtcgtggtgggggacgtcgcgggcatcctggcccaggggaagaagatgatccggccccagcccatggagtacaagtacagctggcgctcctggggcaaggccaagatcatcggcgccgacgtgcagaacacgaccttcatcatcgacgggcccaacaccccggagtgccccgacgaccagcgggcgtggaacatctgggaggtggaggactacggcttcgggatcttcaccacgaacatctggctcaagctgcgcgacagctacacccaggtctgcgaccaccggctgatgtccgccgccatcaaggacagcaaggccgtgcacgccgacatgggctactggatcgagtccgagaagaacgagacctggaagctcgcgcgcgccagcttcatcgaggtgaagacctgcatctggcccaagtcccacacgctgtggagcaacggcgtcctggagtccgagatgatcatccccaagatctacgggggcccgatcagccagcacaactaccggcccgggtacttcacccagaccgccggcccctggcacctcgggaagctggagctggacttcgacctctgcgagggcaccacggtggtggtcgacgagcactgcggcaaccgcgggccgtccctgcggaccaccaccgtgacgggcaagatcatccacgagtggtgctgccgcagctgcaccctgccgcccctccggttccgcggggaggacggctgctggtacgggatggagatccggcccgtgaaggagaaggaggagaacctggtcaagtccatggtgagcgccggcagcggcgaggtggactccttcagcctggggctcctgtgcatctccatcatgatcgaggaggtcatgcgcagccggtggtcccgcaagatgctgatgaccggcaccctcgccgtgttcctgctgctcatcatggggcagctgacgtggaacgacctgatccgcctctgcatcatggtgggcgcgaacgccagcgaccggatggggatgggcaccacctacctggccctgatggccaccttcaagatgcgcccgatgttcgccgtcgggctcctgttccggcgcctgacgtcccgggaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtgctgagcatcgtctccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgcgacgacaccctgaccatcctcctgaaggccaccctgctcgccgtctccggcgtgtacccgctgagcatccccgccacgctgttcgtgtggtacttctggcagaagaagaagcagcggtccggggtcctctgggacacccccagcccgcccgaggtggagcgcgccgtgctggacgacggcatctaccggatcatgcagcgcggcctgctggggcggtcccaggtcggcgtgggggtgttccaggagaacgtcttccacaccatgtggcacgtgacccgcggcgcggtgctcatgtaccaggggaagcggctggagcccagctgggcctccgtcaagaaggacctgatcagctacggcggcgggtggcgcctccagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgggaggggaagatcgtgggcctgtacggcaacggggtggtcaccaccagcggcacctacgtgagcgccatcgcccaggccaaggcgtcccaggaggggccgctccccgagatcgaggacgaggtgttccgcaagcggaacctgacgatcatggacctgcaccccggcagcgggaagacccgccggtacctcccggccatcgtccgcgaggccatcaagcgcaagctgcggaccctgatcctcgcccccacccgcgtggtggcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtgcgggtcccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagaccttcgacacggagtaccagaagaccaagaacaacgactgggactacgtggtgaccaccgacatcagcgagatgggcgcgaacttccgggccgaccgcgtcatcgacccgcggcgctgcctgaagcccgtgatcctgaaggacgggcccgagcgggtgatcctcgccggccccatgccggtcacggtggcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtgtccggggacctgatcctcgagatcggcaagctgccgcagcacctgacccagcgggcccagaacgccctcgacaacctggtcatgctgcacaacagcgagcagggcgggcgcgcgtaccggcacgccatggaggagctccccgacaccatcgagacgctgatgctgctcgccctgatcgccgtgctgaccggcggggtgaccctcttcttcctgtccggccgcgggctgggcaagaccagcatcggcctcctgtgcgtcatggcctccagcgtgctgctctggatggcgtccgtggagccccactggatcgccgccagcatcatcctggagttcttcctgatggtcctcctgatccccgagccggaccggcagcgcacgccccaggacaaccagctggcctacgtggtgatcgggctcctgttcatgatcctgacggtcgccgcgaacgagatgggcctcctggagaccaccaagaaggacctggggatcggccacgtggccgtggggaaccaccaccacgccgccatgctcgacgtcgacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatgggcctggacaagggctggcccatctccaagatggacatcggggtgcccctcctggccctgggctgctacagccaggtcaaccccctcaccctgacggcggccgtgctgatgctcgtggcccactacgccatcatcgggccgggcctgcaggccaaggcgacccgggaggcccagaagcgcaccgccgccgggatcatgaagaaccccaccgtcgacggcatcgtggccatcgacctggaccccgtggtctacgacgcgaagttcgagaagcagctcggccagatcatgctgctgatcctctgcacgtcccagatcctgctgatgcggaccacctgggccctctgcgagagcatcaccctggccacggggcccctgaccaccctctgggagggctccccggggaagttctggaacaccacgatcgccgtgagcatggccaacatcttccgcggctcctacctggcgggcgccgggctggccttcagcctcatgaagtccctgggcgggggccggcgcgggaccggcgcccagggcgagaccctgggggagaagtggaagcggcagctcaaccagctgtccaagagcgagttcaacacctacaagcgctccggcatcatggaggtggaccggagcgaggcgaaggaggggctgaagcgcggcgagatcacgaagcacgccgtctcccgggggaccgccaagctccgctggttcgtggagcggaacctggtgaagcccgagggcaaggtcatcgacctgggctgcgggcgcggcgggtggagctactactgcgccggcctgaagaaggtgaccgaggtgaaggggtacaccaagggcggccccgggcacgaggagcccatcccgatggccacgtacggctggaacctcgtcaagctgcactccgggaaggacgtgttcttcgtgccgcccgagaagtgcgacaccctgctctgcgacatcggcgagagctcccccaacccgaccatcgaggaggggcggaccctgcgcgtcctgaagatggtggagccctggctccggggcaaccagttctgcatcaagatcctgaacccctacatgcccagcgtggtcgagacgctggagcagatgcagcgcaagcacggcgggatgctcgtgcggaacccgctgtcccgcaacagcacccacgagatgtactgggtgtcctgcggcaccgggaacatcgtcagcgcggtgaacatgacctcccgcatgctgctcaaccggttcaccatggcccaccgcaagcccacgtacgagcgggacgtggacctgggcgccggcacccgccacgtcgccgtggagcccgaggtggccaacctggacatcatcgggcagcggatcgagaacatcaagcacgagcacaagagcacctggcactacgacgaggacaacccctacaagacctgggcgtaccacggctcctacgaggtcaagccgagcgggtccgccagcagcatggtgaacggcgtcgtgaagctcctgacgaagccctgggacgtgatccccatggtcacccagatcgccatgaccgacaccacgcccttcgggcagcagcgcgtgttcaaggagaaggtggacacccggaccccgaaggccaagcgcggcaccgcccagatcatggaggtcacggcgaagtggctgtggggcttcctctcccggaacaagaagccccgcatctgcacccgggaggagttcacccgcaaggtgcggagcaacgccgccatcggggccgtgttcgtcgacgagaaccagtggaactccgcgaaggaggccgtggaggacgagcgcttctgggacctggtgcaccgggagcgcgagctgcacaagcagggcaagtgcgcgacctgcgtctacaacatgatggggaagcgggagaagaagctcggcgagttcgggaaggccaagggcagccgcgccatctggtacatgtggctgggcgcgcggttcctggagttcgaggccctcgggttcatgaacgaggaccactggttctcccgcgagaacagcctgtccggcgtggagggggagggcctgcacaagctcgggtacatcctgcgggacatcagcaagatccccggcggcaacatgtacgccgacgacacggccgggtgggacacccgcatcaccgaggacgacctgcagaacgaggcccgcatcaccgacatcatggagccggagcacgcgctcctggccaagtccatcttcaagctgacgtaccagaacaaggtggtccgggtgcagcgccccgccaagaacggcaccgtgatggacgtcatcagccggcgcgaccagcgggggtccggccaggtgggcacctacgggctcaacaccttcacgaacatggaggcccagctgatccgccagatggagagcgagggcatcttctcccccagcgagctggagacccccaacctcgccgagcgggtgctggactggctggagaagtacggggtcgagcgcctcaagcggatggcgatctccggcgacgactgcgtggtgaagccgatcgacgaccgcttcgccaccgccctgaccgccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgcggggtggagcctgcgcgagacggcctgcctcggcaagtcctacgcccagatgtggcagctgatgtacttccaccggcgcgacctgcggctcgccgcgaacgccatctgcagcgccgtccccgtggactggatccccacctcccgcaccacctggagcatccacgcccaccaccagtggatgacgaccgaggacatgctgtccgtgtggaaccgcgtctggatcgaggagaacccctggatggaggacaagacccacatcagcaactggggcgacgtgccgtacctgggcaagcgggaggaccagtggtgcggctccctcatcgggctgaccgcccgcgcgacgtgggccaccaacatccaggtggccatcaaccaggtccggcgcctgatcggcaacgagaactacctcgactacatgaccagcatgaagcggttcaagaacgagtccgaccccgagggggccctgtggtga

SEQ ID NO: 8037 - RNA, 9879 nt, synthetic construct
  misc_feature 1..9879: note = derived and/or modified CDS sequence (opt1) from DENV-1__FJ639695__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatgacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggctgggcgtcctgctcacgtggctgggcctgaactcccgcagcacctccctcagcatgacctgcatcgccgtggggctggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgtcgcgggcatcctggcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtggtcgacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcaccctggccgtgttcctcctgctgatcatggggcagctcacgtggaacgacctgatccgcctgtgcatcatggtgggcgcgaacgccagcgaccgcatggggatgggcaccacctacctcgccctgatggccaccttcaagatgcggccgatgttcgccgtcgggctcctgttccgccggctgacgtcccgcgaggtgctgctcctgaccatcgggctgagcctcgtggcgtccgtcgagctgcccaacagcctggaggagctcggcgacgggctggccatgggcatcatgatcctgaagctcctgaccgacttccagtcccaccagctgtgggccaccctcctgagcctgacgttcatcaagaccaccttctccctccactacgcctggaagaccatggcgatggtgctgagcatcgtctccctgttccccctctgcctgagcacgacctcccagaagaccacctggctgcccgtgctcctgggcagcctggggtgcaagccgctcacgatgttcctgatcgccgagaacaagatctggggccggcgctcctggcccctgaacgaggggatcatggccgtgggcatcgtcagcatcctcctgagctccctgctcaagaacgacgtgcccctggccgggcccctgatcgccggcggcatgctcatcgcgtgctacgtgatcagcgggtccagcgccgacctgtccctggagaaggccgccgaggtcagctgggaggaggaggccgagcactccggcgcgagccacaacatcctcgtggaggtgcaggacgacgggaccatgaagatcaaggacgaggagcgggacgacaccctgaccatcctgctcaaggccaccctgctggccgtctccggcgtgtacccgctcagcatccccgccacgctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgcggtgctgatgtaccaggggaagcgcctcgagcccagctgggcctccgtcaagaaggacctgatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgaggtgggcgccatcgcgctcgacttcaagcccgggacgagcggctcccccatcgtcaaccgcgaggggaagatcgtgggcctgtacggcaacggggtggtcaccaccagcggcacctacgtgagcgccatcgcccaggccaaggcgtcccaggaggggccgctgcccgagatcgaggacgaggtgttccggaagcgcaacctcacgatcatggacctgcaccccggcagcgggaagacccggcgctacctgccggccatcgtccgggaggccatcaagcgcaagctccgcaccctgatcctggcccccacccgggtggtggcctccgagatggcggaggccctcaagggcatgcccatccgctaccagacgaccgccgtcaagagcgagcacaccggcaaggagatcgtggacctgatgtgccacgccaccttcacgatgcggctgctctcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagaccttcgacacggagtaccagaagaccaagaacaacgactgggactacgtggtgaccaccgacatcagcgagatgggcgcgaacttccgcgccgaccgggtcatcgacccgcgccggtgcctcaagcccgtgatcctgaaggacgggcccgagcgcgtgatcctggccggccccatgccggtcacggtggcctccgccgcgcagcggcgcgggcggatcggccgcagccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgccgcgatcgacggggagtaccggctgcgcggcgaggcccggaagaccttcgtcgagctgatgcgccgcggggacctccccgtgtggctgagctacaaggtggccagcgagggcttccagtactccgaccgccggtggtgcttcgacggcgagcgcaacaaccaggtcctggaggagaacatggacgtggagatctggacgaaggagggggagcggaagaagctccgcccccggtggctggacgcccgcacctacagcgaccccctggccctccgggagttcaaggagttcgcggccggccgccggtccgtgagcggggacctgatcctggagatcggcaagctcccgcagcacctgacccagcgcgcccagaacgccctggacaacctcgtcatgctgcacaactccgagcagggcgggcgggcgtaccgccacgccatggaggagctgcccgacaccatcgagacgctcatgctgctggccctcatcgccgtgctgaccggcggggtgaccctgttcttcctcagcggccgggggctgggcaagacctccatcggcctgctctgcgtcatggccagctccgtgctgctgtggatggcgagcgtggagccccactggatcgccgcctccatcatcctcgagttcttcctgatggtcctgctcatccccgagccggaccgccagcggacgccccaggacaaccagctggcctacgtggtgatcgggctcctcttcatgatcctgacggtcgccgcgaacgagatgggcctgctcgagaccaccaagaaggacctggggatcggccacgtggccgtggggaaccaccaccacgccgccatgctggacgtcgacctccaccccgccagcgcgtggaccctgtacgccgtggccacgaccatcatcaccccgatgatgcgccacaccatcgagaacacgaccgccaacatctccctgaccgccatcgcgaaccaggccgccatcctcatgggcctggacaagggctggcccatcagcaagatggacatcggggtgcccctgctcgccctgggctgctactcccaggtcaaccccctgaccctcacggcggccgtgctgatgctggtggcccactacgccatcatcgggccgggcctccaggccaaggcgacccgcgaggcccagaagcggaccgccgccgggatcatgaagaaccccaccgtcgacggcatcgtggccatcgacctggaccccgtggtctacgacgcgaagttcgagaagcagctgggccagatcatgctcctgatcctgtgcacgagccagatcctcctgatgcgcaccacctgggccctgtgcgagtccatcaccctcgccacggggcccctgaccaccctgtgggagggcagcccggggaagttctggaacaccacgatcgccgtgtccatggccaacatcttccggggcagctacctcgcgggcgccgggctggccttcagcctgatgaagtccctcggcgggggccgccgggggaccggcgcccagggcgagaccctgggggagaagtggaagcgccagctgaaccagctcagcaagtccgagttcaacacctacaagcggagcggcatcatggaggtggaccgctccgaggcgaaggaggggctgaagcggggcgagacgaccaagcacgccgtcagccgcgggaccgccaagctgcggtggttcgtggagcgcaacctggtgaagcccgagggcaaggtcatcgacctcggctgcgggcggggcgggtggtcctactactgcgccggcctgaagaaggtgaccgaggtgaaggggtacacgaagggcggccccgggcacgaggagcccatcccgatggccacctacggctggaacctggtcaagctccacagcgggaaggacgtgttcttcatcccgcccgagaagtgcgacaccctgctgtgcgacatcggcgagtccagccccaacccgaccatcgaggaggggcgcacgctccgggtgctgaagatggtcgagccctggctgcgcggcaaccagttctgcatcaagatcctcaacccctacatgccctccgtggtggagaccctggagcagatgcagcggaagcacggcgggatgctggtccgcaacccgctcagccggaactccacccacgagatgtactgggtgagctgcggcaccgggaacatcgtgtccgcggtcaacatgaccagccgcatgctgctgaaccgcttcacgatggcccaccggaagcccacctacgagcgcgacgtggacctcggcgccggcacccggcacgtggccgtcgagcccgaggtggccaacctggacatcatcgggcagcgcatcgagaacatcaagcacgagcacaagtccacctggcactacgacgaggacaacccctacaagacgtgggcgtaccacggcagctacgaggtgaagccgtccgggagcgccagctccatggtcaacggcgtggtcaagctgctcaccaagccctgggacgtgatccccatggtgacccagatcgccatgaccgacacgacccccttcgggcagcagcgggtcttcaaggagaaggtggacacccgcaccccgaaggccaagcggggcacggcccagatcatggaggtgaccgcgaagtggctgtggggcttcctgagccgcaacaagaagccccggatctgcacccgcgaggagttcacccggaaggtccgctccaacgccgccatcggggccgtgttcgtggacgagaaccagtggaacagcgcgaaggaggccgtcgaggacgagcggttctgggacctcgtgcaccgcgagcgggagctgcacaagcagggcaagtgcgccacgtgcgtgtacaacatgatggggaagcgcgagaagaagctgggcgagttcgggaaggccaagggctcccgggccatctggtacatgtggctcggcgcgcgcttcctggagttcgaggccctggggttcatgaacgaggaccactggttcagccgggagaactccctcagcggcgtcgagggggagggcctgcacaagctggggtacatcctccgcgacatctccaagatccccggcggcaacatgtacgccgacgacaccgccgggtgggacacccggatcaccgaggacgacctgcagaacgaggcccgcatcacggacatcatggagccggagcacgcgctgctcgccaagagcatcttcaagctgacctaccagaacaaggtggtgcgcgtccagcggcccgccaagaacggcaccgtgatggacgtgatctcccgccgggaccagcgcgggagcggccaggtcggcacctacgggctgaacacgttcaccaacatggaggcccagctcatccggcagatggagtccgagggcatcttcagcccctccgagctggagacccccaacctggccgagcgcgtgctcgtgtggctggagaagtacggggtcgagcggctgaagcgcatggcgatcagcggcgacgactgcgtggtgaagccgatcgacgaccggttcgccaccgccctcacggccctgaacgacatggggaaggtccgcaaggacatcccccagtgggagccctccaagggctggaacgactggcagcaggtccccttctgcagccaccacttccaccagctgatcatgaaggacggccgggagatcgtggtcccgtgccgcaaccaggacgagctcgtggggcgggcccgcgtgagccagggcgcggggtggtccctgcgggagaccgcctgcctgggcaagagctacgcccagatgtggcagctcatgtacttccaccgccgggacctgcgcctggccgcgaacgccatctgctccgccgtccccgtggactggatccccaccagccggaccacgtggtccatccacgcccaccaccagtggatgaccaccgaggacatgctcagcgtgtggaaccgcgtctggatcgaggagaacccctggatggaggacaagacccacatctccagctggggcgacgtgccgtacctgggcaagcgcgaggaccagtggtgcggctccctgatcgggctcacggcccgggcgacctgggccaccaacatccaggtggccatcaaccaggtccgccggctgatcggcaacgagaactacctggactacatgaccagcatgaagcgcttcaagaacgagtccgaccccgagggggccctctggtga

SEQ ID NO: 8038 - RNA, 9879 nt, synthetic construct
  misc_feature 1..9879: note = derived and/or modified CDS sequence (opt1) from DENV-1__FJ639696__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccggatcagcgaggccgagcccgacgacgtggactgctggtgcaacgccaccgacacctgggtgacctacgggacctgctcccagaccggcgagcaccggcgcgacaagcggagcgtggccctggcgccccacgtgggcctcgggctggagacccggacggagacctggatgtccagcgagggcgcctggaagcagatccagcgggtcgagacctgggccctgcgccaccccgggttcaccgtgatcgccctcttcctggcgcacgccatcggcacgtccatcacccagaaggggatcatcttcatcctgctcatgctggtgacccccagcatggccatgcggtgcgtcggcatcggctcccgcgacttcgtggaggggctgagcggcgccacctgggtggacgtcgtgctcgagcacgggtcctgcgtgacgaccatggccaaggacaagcccaccctggacatcgagctgctcaagaccgaggtcacgaaccccgcggtgctgcggaagctgtgcatcgaggccaagatcagcaacaccaccaccgactcccgctgcccgacgcagggcgaggccaccctcgtggaggagcaggacgccaacttcgtctgccggcgcaccttcgtggaccggggctgggggaacggctgcgggctgttcggcaaggggagcctgatcacgtgcgccaagttcaagtgcgtgacgaagctcgagggcaagatcgtccagtacgagaacctgaagtactccgtgatcgtgaccgtccacaccggcgaccagcaccaggtggggaacgagagcaccgagcacggcacgaccgcgaccatcacgccccaggccccctccaccgagatccagctgacggactacggggccctcaccctggactgcagcccccgcaccggcctggacttcaacgagatggtcctcctgaccatgaaggagaagtcctggctggtgcacaagcagtggttcctcgacctgccgctgccctggacgtccggggccagcacctcccaggagacctggaaccggcaggacctcctggtgaccttcaagacggcccacgcgaagaagcaggaggtcgtggtgctgggcagccaggagggcgccatgcacaccgccctcaccggggccaccgagatccagacgtccggcaccaccaccatcttcgccgggcacctgaagtgccgcctgaagatggacaagctcacgctgaagggcatgagctacgtcatgtgcaccgggtccttcaagctggagaaggaggtggcggagacccagcacggcaccgtgctcgtccagatcaagtacgagggcacggacgccccctgcaagatccccttcagcacccaggacgagaagggggtgacccagaacggccggctgatcaccgccaacccgatcgtgacggacaaggagaagcccgtcaacatcgaggccgagccgcccttcggggagtcctacatcgtgatcggcgcgggcgagaaggccctgaagctgagctggttcaagaaggggtccagcatcggcaagatgttcgaggccaccgcccgcggggcccggcgcatggcgatcctcggcgacaccgcctgggacttcgggtccatcggcggcgtgttcaccagcgtcgggaagctggtgcaccagatcttcggcacggcctacggggtgctgttctccggcgtcagctggaccatgaagatcgggatcggcgtgctcctgacctggctgggcctcaactcccgcagcacctccctgagcatgacgtgcatcgccgtggggctggtcaccctctacctgggcgtgatggtgcaggccgacagcgggtgcgtcatcaactggaagggccgggagctgaagtgcgggtccggcatcttcgtgaccaacgaggtgcacacctggacggagcagtacaagttccaggcggacagcccgaagcgcctctccgccgccatcggcaaggcctgggaggagggggtctgcggcatccggagcgccacccgcctggagaacatcatgtggaagcagatctccaacgagctgaaccacatcctcctggagaacgacatgaagttcaccgtggtggtcggggacgtggcgggcatcctggcccaggggaagaagatgatccggccccagcccatggagtacaagtacagctggaagtcctggggcaaggccaagatcatcggcgccgacgtgcagaacaccaccttcatcatcgacgggcccaacacgccggagtgccccgacgaccagcgcgcgtggaacatctgggaggtcgaggactacggcttcgggatcttcaccaccaacatctggctcaagctgcgggacagctacacccaggtgtgcgaccaccgcctgatgtccgccgccatcaaggacagcaaggccgtgcacgccgacatgggctactggatcgagtccgagaagaacgagacgtggaagctcgcgcgggccagcttcatcgaggtcaagacctgcatctggcccaagtcccacaccctgtggagcaacggcgtgctggagtccgagatgatcatccccaagatctacgggggcccgatcagccagcacaactaccgccccgggtacttcacccagacggccggcccctggcacctcgggaagctggagctggacttcgacctctgcgagggcaccaccgtggtcgtggacgagcactgcggcaaccgggggccgtccctgcgcaccacgaccgtgaccggcaagatcatccacgagtggtgctgccggagctgcaccctgccgcccctgcgcttcaagggggaggacggctgctggtacgggatggagatccggcccgtcaaggagaaggaggagaacctggtcaagagcatggtgtccgccggcagcggcgaggtcgactccttcagcctggggctcctgtgcatctccatcatgatcgaggaggtgatgcgcagccggtggtcccgcaagatgctgatgacgggcaccctcgccgtgttcttcctgctgatcatggggcagctcacctggaacgacctgatccggctgtgcatcatggtcggcgcgaacgccagcgaccgcatggggatgggcatgacctacctcgccctgatggccacgttcaagatgcgcccgatgttcgccgtgggcctcctgttccggcgcctgacctcccgggaggtgctgctcctgaccatcgggctgagcctcgtcgcgtccgtggagctgcccaacagcctggaggagctcggcgacgggctggccatgggcatcatgatcctgaagctcctgaccgacttccagtcccaccagctgtgggccacgctcctgagcctgaccttcatcaagaccaccttctccctccactacgcctggaagacgatggcgatggtcctgagcatcgtgtccctgttccccctctgcctgagcaccacctcccagaagaccacgtggctgcccgtgctcctgggcagcctggggtgcaagccgctcaccatgttcctgatcgccgagaacaagatctggggccgcaagagctggcccctgaacgaggggatcatggccgtcggcatcgtgtccatcctcctgagctccctgctcaagaacgacgtgcccctggccgggcccctgatcgccggcggcatgctcatcgcgtgctacgtcatcagcgggtccagcgccgacctgtccctggagaaggccgccgaggtgagctgggaggaggaggccgagcactccggcgcgagccacaacatcctcgtggaggtccaggacgacgggaccatgaagatcaaggacgaggagcgggacgacaccctgacgatcctgctcaaggccaccctgctggccgtgtccggcgtgtacccgctcagcatccccgccaccctgttcgtctggtacttctggcagaagaagaagcagcgctccggggtgctgtgggacacccccagcccgcccgaggtggagcgggccgtcctcgacgacggcatctaccgcatcatgcagcggggcctgctggggcgctcccaggtgggcgtgggggtcttccaggagaacgtgttccacaccatgtggcacgtgacgcggggcgcggtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagaccgcccccgggaccttcaagacgagcgagggcgaggtcggcgccatcgcgctcgacttcaagcccgggaccagcggctcccccatcgtgaaccgcgaggggaagatcgtgggcctgtacggcaacggggtcgtgaccaccagcggcacgtacgtgtccgccatcgcccaggccaaggcgagccaggaggggcccctgccggagatcgaggacgaggtcttccggaagcgcaacctcaccatcatggacctgcaccccggctccgggaagacccggcgctacctgcccgccatcgtgcgggaggccatcaagcgcaagctccggaccctgatcctggccccgacgcgcgtggtcgccagcgagatggcggaggccctcaagggcatgcccatccgctaccagaccaccgccgtgaagtccgagcacaccggcaaggagatcgtggacctgatgtgccacgccacgttcaccatgcggctgctcagccccgtccgcgtgcccaactacaacatgatcatcatggacgaggcccacttcaccgacccgtccagcatcgcggcccgggggtacatctccacccgcgtgggcatgggggaggccgccgccatcttcatgacggcgacgccgcccggcagcgtcgaggccttcccccagtccaacgccgtgatccaggacgaggagcgggacatcccggagcgcagctggaactccgggtacgagtggatcaccgacttccccggcaagaccgtgtggttcgtccccagcatcaagtccggcaacgacatcgccaactgcctgcggaagaacgggaagcgcgtgatccagctgagccggaagacgttcgacaccgagtaccagaagaccaagaacaacgactgggactacgtggtcaccacggacatctccgagatgggcgcgaacttccgcgccgaccgggtgatcgacccccgccggtgcctcaagccggtgatcctgaaggacgggcccgagcgcgtcatcctggccggccccatgcccgtgaccgtcgccagcgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagacgttcgtggagctgatgcgccgcggggacctcccggtgtggctgtcctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcccgcacctacagcgaccccctggccctccgggagttcaaggagttcgcggccggccgccggtccgtcagcggggacctgatcctggagatcggcaagctcccccagcacctgacccagcgcgcccagaacgccctggacaacctcgtgatgctgcacaactccgagcagggcgggcgggcgtaccgccacgccatggaggagctgccggacacgatcgagaccctcatgctgctggccctcatcgccgtgctgaccggcggggtcaccctgttcttcctcagcggccgggggctgggcaagacgtccatcggcctgctctgcgtgatggccagctccgtgctgctgtggatggcgagcgtcgagccccactggatcgccgcctccatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagaccaccaagaaggacctggggatcggccacgtggccgtcgagaaccaccaccacgccgccatgctggacgtggacctccaccccgccagcgcgtggacgctgtacgccgtggccaccaccatcatcacccccatgatgcgccacacgatcgagaacaccaccgccaacatctccctgaccgccatcgcgaaccaggccgccatcctcatggggctggacaagggctggccgatcagcaagatggacatcggcgtccccctgctcgccctggggtgctactcccaggtgaaccccctgacgctcaccgcggccgtgctgatgctggtcgcccactacgccatcatcggccccgggctccaggccaaggcgacccgggaggcccagaagcgcaccgccgccggcatcatgaagaacccgacggtggacgggatcgtggccatcgacctggaccccgtcgtgtacgacgcgaagttcgagaagcagctgggccagatcatgctcctgatcctgtgcaccagccagatcctcctgatgcgcaccacctgggccctgtgcgagtccatcacgctcgccaccggccccctgaccaccctgtgggaggggagccccggcaagttctggaacacgaccatcgccgtgagcatggccaacatcttccgggggtcctacctcgcgggcgccggcctggccttcagcctgatgaagtccctcgggggcgggcgccggggcaccggggcccagggcgagaccctgggcgagaagtggaagcgccagctgaaccagctcagcaagtccgagttcaacacgtacaagcggagcgggatcatggaggtcgaccgctccgaggcgaaggagggcctgaagcgcggggagaccaccaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgacggaggtcaaggggtacaccaagggcgggcccggccacgaggagcccatccccatggccacctacgggtggaacctggtgaagctccacagcggcaaggacgtgttcttcgtcccgcccgagaagtgcgacaccctgctgtgcgacatcggggagtccagccccaaccccacgatcgaggagggccgcaccctccgggtgctgaagatggtggagccgtggctgcgcgggaaccagttctgcatcaagatcctcaacccctacatgccctccgtcgtggagaccctggagcagatgcagcggaagcacggcggcatgctggtgcgcaaccccctcagccggaactccacccacgagatgtactgggtcagctgcgggacgggcaacatcgtgtccgcggtgaacatgaccagccgcatgctgctgaaccggttcaccatggcccaccgcaagccgacctacgagcgcgacgtcgacctcggggccggcacccggcacgtggccgtggagcccgaggtcgccaacctggacatcatcggccagcgcatcgagaacatcaagcacgagcacaagtccacgtggcactacgacgaggacaacccctacaagacctgggcgtaccacgggagctacgaggtgaagcccagcggctccgccagctccatggtcaacggggtggtgaagctgctcaccaagccgtgggacgtcatccccatggtgacccagatcgccatgacggacaccacccccttcggccagcagcgggtgttcaaggagaaggtcgacacccgcacgcccaaggccaagcgggggaccgcccagatcatggaggtgaccgcgaagtggctgtggggcttcctgagccgcaacaagaagccgcggatctgcacccgcgaggagttcacgcggaaggtgcgctccaacgccgccatcggcgccgtcttcgtggacgagaaccagtggaacagcgcgaaggaggccgtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggtcccgggccatctggtacatgtggctcggcgcgcgcttcctggagttcgaggccctgggcttcatgaacgaggaccactggttcagccgggagaactccctcagcggggtggagggcgaggggctgcacaagctgggctacatcctccgcgacatctccaagatcagcgggggcaacatgtacgccgacgacaccgccggctgggacacccggatcacggaggacgacctgcagaacgaggccaagatcaccgacatcatggagcccgagcacgcgctgctcgccaagtccatcttcaagctgacctaccagaacaaggtcgtgcgcgtgcagcggcccgccaagaacgggaccgtcatggacgtgatcagccgccgcgaccagcggggctccggccaggtgggcacgtacggcctgaacaccttcaccaacatggaggcccagctcatccgccagatggagagcgaggggatcttctccccgagcgagctggagacccccaacctggccgagcgggcgctcgactggctggagaagcacggcgtcgagcgcctgaagcggatggccatcagcggggacgactgcgtggtgaagcccatcgacgaccgcttcgccacggccctcaccgccctgaacgacatgggcaaggtccggaaggacatcccccagtgggagccgtccaaggggtggaacgactggcagcaggtccccttctgcagccaccacttccaccagctgatcatgaaggacggccgcgagatcgtggtcccctgccggaaccaggacgagctcgtgggccgcgcgcgggtgtcccagggggccggctggagcctgcgcgagaccgcctgcctggggaagtcctacgcccagatgtggcagctcatgtacttccaccggcgcgacctgcggctggcggccaacgccatctgcagcgccgtccccgtggactgggtgccgacctcccgcacgacctggagcatccacgcccaccaccagtggatgaccaccgaggacatgctctccgtctggaaccgggtgtggatcgaggagaacccctggatggaggacaagacgcacatcagctcctgggaggacgtgccctacctgggcaagcgcgaggaccagtggtgcgggagcctgatcggcctcaccgcgcgggccacctgggccaccaacatccaggtcgccatcaaccaggtgcgccgcctgatcggcaacgagaactacctggactacatgacgtccatgaagcggttcaagaacgagagcgacctcgagggggccctgtggtga

SEQ ID NO: 8039 - RNA, 9879 nt, synthetic construct
  misc_feature 1..9879: note = derived and/or modified CDS sequence (opt1) from DENV-1__HM181937__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctgcgggacagctacacccaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggccgtgttcctgctcctgatcatggggcagctgacgtggaacgacctcatccgcctgtgcatcatggtgggcgcgaacgccagcgaccgcatggggatgggcaccacctacctggccctcatggccaccttcaagatgcggccgatgttcgccgtcgggctgctgttccgccggctcacgtcccgcgaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcgtgctacgtgatcagcgggtccagcgccgacctctccctggagaaggccgccgaggtcagctgggaggaggaggccgagcactccggcgcgagccacaacatcctggtggaggtgcaggacgacgggaccatgaagatcaaggacgaggagcgggacgacaccctcaccatcctgctgaaggccaccctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacccggggcgcggtgctgatgtaccaggggaagcgcctggagcccagctgggcctccgtcaagaaggacctcatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgcgaggggaagatcgtgggcctctacggcaacggggtggtcaccaccagcggcacctacgtgagcgccatcgcccaggccaaggcgtcccaggaggggccgctgcccgagatcgaggacgaggtgttccggaagcgcaacctgacgatcatggacctccaccccggcagcgggaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctcaaggacgggcccgagcgcgtgatcctggccggccccatgccggtcacggtggcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggacgaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtcatgctccacaacagcgagcagggcgggcgggcgtaccgccacgccatggaggagctgcccgacaccatcgagacgctgatgctcctggccctgatcgccgtgctcaccggcggggtgaccctgttcttcctgtccggccgggggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccgccagcggacgccccaggacaaccagctcgcctacgtggtgatcgggctgctgttcatgatcctcacggtcgccgcgaacgagatgggcctgctggagaccaccaagaaggacctcgggatcggccacgtggccgtggggaaccaccaccacgccgccatgctggacgtcgacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtgcccctgctggccctcggctgctacagccaggtcaaccccctgaccctgacggcggccgtgctcatgctggtggcccactacgccatcatcgggccgggcctgcaggccaaggcgacccgcgaggcccagaagcggaccgccgccgggatcatgaagaaccccaccgtcgacggcatcgtggccatcgacctcgaccccgtggtctacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtggaccgcagcgaggcgaaggaggggctcaagcggggcgagacgaccaagcacgccgtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacacgaagggcggccccgggcacgaggagcccatcccgatggccacctacggctggaacctggtcaagctgcactccgggaaggacgtgttcttcatcccgcccgagaagtgcgacaccctcctgtgcgacatcggcgagagctcccccaacccgaccatcgaggaggggcgcacgctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccggaacagcacccacgagatgtactgggtgtcctgcggcaccgggaacatcgtgagcgcggtcaacatgacctcccgcatgctcctgaaccgcttcacgatggcccaccggaagcccacctacgagcgcgacgtggacctgggcgccggcacccggcacgtggccgtcgagcccgaggtggccaacctcgacatcatcgggcagcgcatcgagaacatcaagcacgagcacaagagcacctggcactacgacgaggacaacccctacaagacgtgggcgtaccacggctcctacgaggtgaagccgagcgggtccgccagcagcatggtcaacggcgtggtcaagctgctgaccaagccctgggacgtgatccccatggtgacccagatcgccatgaccgacacgacccccttcgggcagcagcgggtcttcaaggagaaggtggacacccgcaccccgaaggccaagcggggcacggcccagatcatggaggtgaccgcgaagtggctctggggcttcctgtcccgcaacaagaagccccggatctgcacccgcgaggagttcacccggaaggtccgcagcaacgccgccatcggggccgtgttcgtggacgagaaccagtggaactccgcgaaggaggccgtcgaggacgagcggttctgggacctggtgcacaaggagcgcgagctccacaagcagggcaagtgcgccacgtgcgtgtacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgccgacgacaccgccgggtgggacacccgcatcaccgaggacgacctccagaacgaggcccggatcacggacatcatggagccggagcacgcgctgctggccaagtccatcttcaagctcacctaccagaacaaggtggtgcgcgtccagcgccccgccaagaacggcaccgtgatggacgtgatcagccggcgcgaccagcgggggtccggccaggtcggcacctacgggctgaacacgttcaccaacatcgaggcccagctgatccgccagatggagagcgagggcatcttctcccccagcgagctcgagacccccaacctggccgagcgggtgctggactggctcgagaagtacggggtggagcgcctgaagcggatggcgatctccggcgacgactgcgtcgtgaagccgatcgacgaccgcttcgccaccgccctgacggccctcaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctggtcgggcgcgcccgggtgagccagggcgcggggtggagcctccgcgagaccgcctgcctgggcaagtcctacgcccagatgtggcagctgatgtacttccaccggcgcgacctccggctggccgcgaacgccatctgcagcgccgtgcccgtcgactggatccccacctcccgcaccacgtggagcatccacgcccaccaccagtggatgaccaccgaggacatgctgtccgtgtggaaccgggtgtggatcgaggagaacccctggatggaggacaagacccacatcagctcctggggcgacgtcccgtacctcggcaagcgcgaggaccagtggtgcggcagcctgatcgggctgacggcccgcgcgacctgggccaccaacatccaggtggccatcaaccaggtgcggcgcctcatcggcaacgagaactacctggactacatgacctccatgaagcggttcaagaacgagagcgaccccgagggggccctgtggtga

SEQ ID NO: 8040 - RNA, 9879 nt, synthetic construct
  misc_feature 1..9879: note = derived and/or modified CDS sequence (opt1) from DENV-1__HM181939__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccggatcagcgaggccgagcccgacgacgtggactgctggtgcaacgccaccgacacctgggtgacctacgggacctgctcccagaccggcgagcaccggcgcgacaagcggagcgtggccctggcgccccacgtgggcctcgggctggagacccggacggagacctggatgtccagcgagggcgcctggaagcagatccagcgggtcgagacctgggccctgcgccaccccgggttcaccgtgatcgccctcttcctggcgcacgccatcggcacgtccatcacccagaaggggatcatcttcatcctgctcatgctggtgacccccagcatggccatgcggtgcgtcggcatcggctcccgcgacttcgtggaggggctgagcggcgccacctgggtggacgtcgtgctcgagcacgggtcctgcgtgacgaccatggccaaggacaagcccaccctggacatcgagctgctcaagaccgaggtcacgaaccccgcggtgctgcggaagctgtgcatcgaggccaagatcagcaacaccaccaccgactcccgctgcccgacgcagggcgaggccaccctcgtggaggagcaggacgccaacttcgtctgccggcgcaccttcgtggaccggggctgggggaacggctgcgggctgttcggcaaggggagcctgatcacgtgcgccaagttcaagtgcgtgacgaagctcgagggcaagatcgtccagtacgagaacctgaagtactccgtgatcgtgaccgtccacaccggcgaccagcaccaggtggggaacgagagcaccgagcacggcacgaccgcgaccatcacgccccaggccccctccaccgagatccagctgacggactacggggccctcaccctggactgcagcccccgcaccggcctggacttcaacgagatggtcctcctgaccatgaaggagaagtcctggctggtgcacaagcagtggttcctcgacctgccgctgccctggacgtccggggccagcacctcccaggagacctggaaccggcaggacctcctggtgaccttcaagacggcccacgcgaagaagcaggaggtcgtggtgctgggcagccaggagggcgccatgcacaccgccctcaccggggccaccgagatccagacgtccggcaccaccaccatcttcgccgggcacctgaagtgccgcctgaagatggacaagctcacgctgaagggcatgagctacgtcatgtgcaccgggtccttcaagctggagaaggaggtggcggagacccagcacggcaccgtgctcgtccagatcaagtacgagggcacggacgccccctgcaagatccccttcagcacccaggacgagaagggggtgacccagaacggccggctgatcaccgccaacccgatcgtgacggacaaggagaagcccgtcaacatcgaggccgagccgcccttcggggagtcctacatcgtgatcggcgcgggcgagaaggccctgaagctgagctggttcaagaaggggtccagcatcggcaagatgttcgaggccaccgcccgcggggcccggcgcatggcgatcctcggcgacaccgcctgggacttcgggtccatcggcggcgtgttcaccagcgtcgggaagctggtgcaccagatcttcggcacggcctacggggtgctgttctccggcgtcagctggaccatgaagatcgggatcggcgtgctcctgacctggctgggcctcaactcccgcagcacctccctgagcatgacgtgcatcgccgtggggctggtcaccctctacctgggcgtgatggtgcaggccgacagcgggtgcgtcatcaactggaagggccgggagctgaagtgcgggtccggcatcttcgtgaccaacgaggtgcacacctggacggagcagtacaagttccaggcggacagcccgaagcgcctctccgccgccatcggcaaggcctgggaggagggggtctgcggcatccggagcgccacccgcctggagaacatcatgtggaagcagatctccaacgagctgaaccacatcctcctggagaacgacatgaagttcaccgtggtggtcggggacgtggcgggcatcctggcccaggggaagaagatgatccggccccagcccatggagtacaagtacagctggaagtcctggggcaaggccaagatcatcggcgccgacgtgcagaacaccaccttcatcatcgacgggcccaacacgccggagtgccccgacgaccagcgcgcgtggaacatctgggaggtcgaggactacggcttcgggatcttcaccaccaacatctggctcaagctgcgggacagctacacccaggtgtgcgaccaccgcctgatgtccgccgccatcaaggacagcaaggccgtgcacgccgacatgggctactggatcgagtccgagaagaacgagacgtggaagctcgcgcgggccagcttcatcgaggtcaagacctgcatctggcccaagtcccacaccctgtggagcaacggcgtgctggagtccgagatgatcatccccaagatctacgggggcccgatcagccagcacaactaccgccccgggtacttcacccagacggccggcccctggcacctcgggaagctggagctggacttcgacctctgcgagggcaccaccgtggtcgtggacgagcactgcggcaaccgggggccgtccctgcgcaccacgaccgtgaccggcaagatcatccacgagtggtgctgccggagctgcaccctgccgcccctgcgcttcaagggggaggacggctgctggtacgggatggagatccggcccgtcaaggagaaggaggagaacctggtcaagagcatggtgtccgccggcagcggcgaggtcgactccttcagcctggggctcctgtgcatctccatcatgatcgaggaggtgatgcgcagccggtggtcccgcaagatgctgatgacgggcaccctcgccgtgttcttcctgctgatcatggggcagctcacctggaacgacctgatccggctgtgcatcatggtcggcgcgaacgccagcgaccgcatggggatgggcatgacctacctcgccctgatggccacgttcaagatgcgcccgatgttcgccgtgggcctcctgttccggcgcctgacctcccgggaggtgctgctcctgaccatcgggctgagcctcgtcgcgtccgtggagctgcccaacagcctggaggagctcggcgacgggctggccatgggcatcatgatcctgaagctcctgaccgacttccagtcccaccagctgtgggccacgctcctgagcctgaccttcatcaagaccaccttctccctccactacgcctggaagacgatggcgatggtcctgagcatcgtgtccctgttccccctctgcctgagcaccacctcccagaagaccacgtggctgcccgtgctcctgggcagcctggggtgcaagccgctcaccatgttcctgatcgccgagaacaagatctggggccgcaagagctggcccctgaacgaggggatcatggccgtcggcatcgtgtccatcctcctgagctccctgctcaagaacgacgtgcccctggccgggcccctgatcgccggcggcatgctcatcgcgtgctacgtcatcagcgggtccagcgccgacctgtccctggagaaggccgccgaggtgagctgggaggaggaggccgagcactccggcgcgagccacaacatcctcgtggaggtccaggacgacgggaccatgaagatcaaggacgaggagcgggacgacaccctgacgatcctgctcaaggccaccctgctggccgtgtccggcgtgtacccgctcagcatccccgccaccctgttcgtctggtacttctggcagaagaagaagcagcgctccggggtgctgtgggacacccccagcccgcccgaggtggagcgggccgtcctcgacgacggcatctaccgcatcatgcagcggggcctgctggggcgctcccaggtgggcgtgggggtcttccaggagaacgtgttccacaccatgtggcacgtgacgcggggcgcggtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagaccgcccccgggaccttcaagacgagcgagggcgaggtcggcgccatcgcgctcgacttcaagcccgggaccagcggctcccccatcgtgaaccgcgaggggaagatcgtgggcctgtacggcaacggggtcgtgaccaccagcggcacgtacgtgtccgccatcgcccaggccaaggcgagccaggaggggcccctgccggagatcgaggacgaggtcttccggaagcgcaacctcaccatcatggacctgcaccccggctccgggaagacccggcgctacctgcccgccatcgtgcgggaggccatcaagcgcaagctccggaccctgatcctggccccgacgcgcgtggtcgccagcgagatggcggaggccctcaagggcatgcccatccgctaccagaccaccgccgtgaagtccgagcacaccggcaaggagatcgtggacctgatgtgccacgccacgttcaccatgcggctgctcagccccgtccgcgtgcccaactacaacatgatcatcatggacgaggcccacttcaccgacccgtccagcatcgcggcccgggggtacatctccacccgcgtgggcatgggggaggccgccgccatcttcatgacggcgacgccgcccggcagcgtcgaggccttcccccagtccaacgccgtgatccaggacgaggagcgggacatcccggagcgcagctggaactccgggtacgagtggatcaccgacttccccggcaagaccgtgtggttcgtccccagcatcaagtccggcaacgacatcgccaactgcctgcggaagaacgggaagcgcgtgatccagctgagccggaagacgttcgacaccgagtaccagaagaccaagaacaacgactgggactacgtggtcaccacggacatctccgagatgggcgcgaacttccgcgccgaccgggtgatcgacccccgccggtgcctcaagccggtgatcctgaaggacgggcccgagcgcgtcatcctggccggccccatgcccgtgaccgtcgccagcgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagacgttcgtggagctgatgcgccgcggggacctcccggtgtggctgtcctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcccgcacctacagcgaccccctggccctccgggagttcaaggagttcgcggccggccgccggtccgtcagcggggacctgatcctggagatcggcaagctcccccagcacctgacccagcgcgcccagaacgccctggacaacctcgtgatgctgcacaactccgagcagggcgggcgggcgtaccgccacgccatggaggagctgccggacacgatcgagaccctcatgctgctggccctcatcgccgtgctgaccggcggggtcaccctgttcttcctcagcggccgggggctgggcaagacgtccatcggcctgctctgcgtgatggccagctccgtgctgctgtggatggcgagcgtcgagccccactggatcgccgcctccatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagaccaccaagaaggacctggggatcggccacgtggccgtcgagaaccaccaccacgccgccatgctggacgtggacctccaccccgccagcgcgtggacgctgtacgccgtggccaccaccatcatcacccccatgatgcgccacacgatcgagaacaccaccgccaacatctccctgaccgccatcgcgaaccaggccgccatcctcatggggctggacaagggctggccgatcagcaagatggacatcggcgtccccctgctcgccctggggtgctactcccaggtgaaccccctgacgctcaccgcggccgtgctgatgctggtcgcccactacgccatcatcggccccgggctccaggccaaggcgacccgggaggcccagaagcgcaccgccgccggcatcatgaagaacccgacggtggacgggatcgtggccatcgacctggaccccgtcgtgtacgacgcgaagttcgagaagcagctgggccagatcatgctcctgatcctgtgcaccagccagatcctcctgatgcgcaccacctgggccctgtgcgagtccatcacgctcgccaccggccccctgaccaccctgtgggaggggagccccggcaagttctggaacacgaccatcgccgtgagcatggccaacatcttccgggggtcctacctcgcgggcgccggcctggccttcagcctgatgaagtccctcgggggcgggcgccggggcaccggggcccagggcgagaccctgggcgagaagtggaagcgccagctgaaccagctcagcaagtccgagttcaacacgtacaagcggagcgggatcatggaggtcgaccgctccgaggcgaaggagggcctgaagcgcggggagaccaccaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgacggaggtcaaggggtacaccaagggcgggcccggccacgaggagcccatccccatggccacctacgggtggaacctggtgaagctccacagcggcaaggacgtgttcttcgtcccgcccgagaagtgcgacaccctgctgtgcgacatcggggagtccagccccaaccccacgatcgaggagggccgcaccctccgggtgctgaagatggtggagccgtggctgcgcgggaaccagttctgcatcaagatcctcaacccctacatgccctccgtcgtggagaccctggagcagatgcagcggaagcacggcggcatgctggtgcgcaaccccctcagccggaactccacccacgagatgtactgggtcagctgcgggacgggcaacatcgtgtccgcgatcaacatgaccagccgcatgctgctgaaccggttcaccatggcccaccgcaagccgacctacgagcgcgacgtggacctcggggccggcacccggcacgtcgccgtggagcccgaggtggccaacctggacatcatcggccagcgcatcgagaacatcaagcacgagcacaagtccacgtggcactacgacgaggacaacccctacaagacctgggcgtaccacgggagctacgaggtcaagcccagcggctccgccagctccatggtgaacggggtcgtgaagctgctcaccaagccgtgggacgtgatccccatggtcacccagatcgccatgacggacaccacccccttcggccagcagcgggtgttcaaggagaaggtggacacccgcacgcccaaggccaagcgggggaccgcccagatcatggaggtcaccgcgaagtggctgtggggcttcctgagccgcaacaagaagccgcggatctgcacccgcgaggagttcacgcggaaggtgcgctccaacgccgccatcggcgccgtgttcgtcgacgagaaccagtggaacagcgcgaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggtcccgggccatctggtacatgtggctcggcgcgcgcttcctggagttcgaggccctgggcttcatgaacgaggaccactggttcagccgggagaactccctcagcggggtggagggcgaggggctgcacaagctgggctacatcctccgcgacatctccaagatcagcgggggcaacatgtacgccgacgacaccgccggctgggacacccggatcacggaggacgacctgcagaacgaggccaagatcaccgacatcatggagcccgagcacgcgctgctcgccaactccatcttcaagctgacctaccagaacaaggtggtccgcgtgcagcggcccgccaagaacgggaccgtgatggacgtcatcagccgccgcgaccagcggggctccggccaggtgggcacgtacggcctgaacaccttcaccaacatggaggcccagctcatccgccagatggagagcgaggggatcttctccccgagcgagctggagacccccaacctggccgagcgggtgctcgactggctggagaagcacggcgtcgagcgcctgaagcggatggcgatcagcggggacgactgcgtggtgaagcccatcgacgaccgcttcgccacggccctcaccgccctgaacgacatgggcaaggtccggaaggacatcccccagtgggagccgtccaaggggtggaacgactggcagcaggtccccttctgcagccaccacttccaccagctgatcatgaaggacggccgcgagatcgtggtcccctgccggaaccaggacgagctcgtgggccgcgcccgggtgtcccagggggcgggctggagcctgcgcgagaccgcctgcctggggaagtcctacgcccagatgtggcagctcatgtacttccaccggcgcgacctgcggctggccgcgaacgccatctgcagcgccgtccccgtggactgggtgccgacctcccgcacgacctggagcatccacgcccaccaccagtggatgaccaccgaggacatgctctccgtctggaaccgggtgtggatcgaggagaacccctggatggaggacaagacgcacatcagctcctgggaggacgtgccctacctgggcaagcgcgaggaccagtggtgcgggagcctgatcggcctcaccgcccgggcgacctgggccaccaacatccaggtcgccatcaaccaggtgcgccgcctgatcggcaacgagaactacctggactacatgacgtccatgaagcggttcaagaacgagagcgaccccgagggggccctctggtga

SEQ ID NO: 8041 - RNA, 9879 nt, synthetic construct
  misc_feature 1..9879: note = derived and/or modified CDS sequence (opt1) from DENV-1__HM181942__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccggatcagcgaggccgagcccgacgacgtggactgctggtgcaacgccaccgacacctgggtgacctacgggacctgctcccagaccggcgagcaccggcgcgacaagcggagcgtggccctggcgccccacgtgggcctcgggctggagacccggacggagacctggatgtccagcgagggcgcctggaagcagatccagcgggtcgagacctgggccctgcgccaccccgggttcaccgtgatcgccctcttcctggcgcacgccatcggcacgtccatcacccagaaggggatcatcttcatcctgctcatgctggtgacccccagcatggccatgcggtgcgtcggcatcggctcccgcgacttcgtggaggggctgagcggcgccacctgggtggacgtcgtgctcgagcacgggtcctgcgtgacgaccatggccaaggacaagcccaccctggacatcgagctgctcaagaccgaggtcacgaaccccgcggtgctgcggaagctgtgcatcgaggccaagatcagcaacaccaccaccgactcccgctgcccgacgcagggcgaggccaccctcgtggaggagcaggacgccaacttcgtctgccggcgcaccttcgtggaccggggctgggggaacggctgcgggctgttcggcaaggggagcctgatcacgtgcgccaagttcaagtgcgtgacgaagctcgagggcaagatcgtccagtacgagaacctgaagtactccgtgatcgtgaccgtccacaccggcgaccagcaccaggtggggaacgagagcaccgagcacggcacgaccgcgaccatcacgccccaggccccctccaccgagatccagctgacggactacggggccctcaccctggactgcagcccccgcaccggcctggacttcaacgagatggtcctcctgaccatgaaggagaagtcctggctggtgcacaagcagtggttcctcgacctgccgctgccctggacgtccggggccagcacctcccaggagacctggaaccggcaggacctcctggtgaccttcaagacggcccacgcgaagaagcaggaggtcgtggtgctgggcagccaggagggcgccatgcacaccgccctcaccggggccaccgagatccagacgtccggcaccaccaccatcttcgccgggcacctgaagtgccgcctgaagatggacaagctcacgctgaagggcatgagctacgtcatgtgcaccgggtccttcaagctggagaaggaggtggcggagacccagcacggcaccgtgctcgtccagatcaagtacgagggcacggacgccccctgcaagatccccttcagcacccaggacgagaagggggtgacccagaacggccggctgatcaccgccaacccgatcgtgacggacaaggagaagcccgtcaacatcgaggccgagccgcccttcggggagtcctacatcgtgatcggcgcgggcgagaaggccctgaagctgagctggttcaagaaggggtccagcatcggcaagatgttcgaggccaccgcccgcggggcccggcgcatggcgatcctcggcgacaccgcctgggacttcgggtccatcggcggcgtgttcaccagcgtcgggaagctggtgcaccagatcttcggcacggcctacggggtgctgttctccggcgtcagctggaccatgaagatcgggatcggcgtgctcctgacctggctgggcctcaactcccgcagcacctccctgagcatgacgtgcatcgccgtggggctggtcaccctctacctgggcgtgatggtgcaggccgacagcgggtgcgtcatcaactggaagggccgggagctgaagtgcgggtccggcatcttcgtgaccaacgaggtgcacacctggacggagcagtacaagttccaggcggacagcccgaagcgcctctccgccgccatcggcaaggcctgggaggagggggtctgcggcatccggagcgccacccgcctggagaacatcatgtggaagcagatctccaacgagctgaaccacatcctcctggagaacgacatgaagttcaccgtggtggtcggggacgtggcgggcatcctggcccaggggaagaagatgatccggccccagcccatggagtacaagtacagctggaagtcctggggcaaggccaagatcatcggcgccgacgtgcagaacaccaccttcatcatcgacgggcccaacacgccggagtgccccgacgaccagcgcgcgtggaacatctgggaggtcgaggactacggcttcgggatcttcaccaccaacatctggctcaagctgcgggacagctacacccaggtgtgcgaccaccgcctgatgtccgccgccatcaaggacagcaaggccgtgcacgccgacatgggctactggatcgagtccgagaagaacgagacgtggaagctcgcgcgggccagcttcatcgaggtcaagacctgcatctggcccaagtcccacaccctgtggagcaacggcgtgctggagtccgagatgatcatccccaagatctacgggggcccgatcagccagcacaactaccgccccgggtacttcacccagacggccggcccctggcacctcgggaagctggagctggacttcgacctctgcgagggcaccaccgtggtcgtggacgagcactgcggcaaccgggggccgtccctgcgcaccacgaccgtgaccggcaagatcatccacgagtggtgctgccggagctgcaccctgccgcccctgcgcttcaagggggaggacggctgctggtacgggatggagatccggcccgtcaaggagaaggaggagaacctggtcaagagcatggtgtccgccggcagcggcgaggtcgactccttcagcctggggctcctgtgcatctccatcatgatcgaggaggtgatgcgcagccggtggtcccgcaagatgctgatgacgggcaccctcgccgtgttcttcctgctgatcatggggcagctcacctggaacgacctgatccggctgtgcatcatggtcggcgcgaacgccagcgaccgcatggggatgggcatgacctacctcgccctgatggccacgttcaagatgcgcccgatgttcgccgtgggcctcctgttccggcgcctgacctcccgggaggtgctgctcctgaccatcgggctgagcctcgtcgcgtccgtggagctgcccaacagcctggaggagctcggcgacgggctggccatgggcatcatgatcctgaagctcctgaccgacttccagtcccaccagctgtgggccacgctcctgagcctgaccttcatcaagaccaccttctccctccactacgcctggaagacgatggcgatggtcctgagcatcgtgtccctgttccccctctgcctgagcaccacctcccagaagaccacgtggctgcccgtgctcctgggcagcctggggtgcaagccgctcaccatgttcctgatcgccgagaacaagatctggggccgcaagagctggcccctgaacgaggggatcatggccgtcggcatcgtgtccatcctcctgagctccctgctcaagaacgacgtgcccctggccgggcccctgatcgccggcggcatgctcatcgcgtgctacgtcatcagcgggtccagcgccgacctgtccctggagaaggccgccgaggtgagctgggaggaggaggccgagcactccggcgcgagccacaacatcctcgtggaggtccaggacgacgggaccatgaagatcaaggacgaggagcgggacgacaccctgacgatcctgctcaaggccaccctgctggccgtgtccggcgtgtacccgctcagcatccccgccaccctgttcgtctggtacttctggcagaagaagaagcagcgctccggggtgctgtgggacacccccagcccgcccgaggtggagcgggccgtcctcgacgacggcatctaccgcatcatgcagcggggcctgctggggcgctcccaggtgggcgtgggggtcttccaggagaacgtgttccacaccatgtggcacgtgacgcggggcgcggtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagaccgcccccgggaccttcaagacgagcgagggcgaggtcggcgccatcgcgctcgacttcaagcccgggaccagcggctcccccatcgtgaaccgcgaggggaagatcgtgggcctgtacggcaacggggtcgtgaccaccagcggcacgtacgtgtccgccatcgcccaggccaaggcgagccaggaggggcccctgccggagatcgaggacgaggtcttccggaagcgcaacctcaccatcatggacctgcaccccggctccgggaagacccggcgctacctgcccgccatcgtgcgggaggccatcaagcgcaagctccggaccctgatcctggccccgacgcgcgtggtcgccagcgagatggcggaggccctcaagggcatgcccatccgctaccagaccaccgccgtgaagtccgagcacaccggcaaggagatcgtggacctgatgtgccacgccacgttcaccatgcggctgctcagccccgtccgcgtgcccaactacaacatgatcatcatggacgaggcccacttcaccgacccgtccagcatcgcggcccgggggtacatctccacccgcgtgggcatgggggaggccgccgccatcttcatgacggcgacgccgcccggcagcgtcgaggccttcccccagtccaacgccgtgatccaggacgaggagcgggacatcccggagcgcagctggaactccgggtacgagtggatcaccgacttccccggcaagaccgtgtggttcgtccccagcatcaagtccggcaacgacatcgccaactgcctgcggaagaacgggaagcgcgtgatccagctgagccggaagacgttcgacaccgagtaccagaagaccaagaacaacgactgggactacgtggtcaccacggacatctccgagatgggcgcgaacttccgcgccgaccgggtgatcgacccccgccggtgcctcaagccggtgatcctgaaggacgggcccgagcgcgtcatcctggccggccccatgcccgtgaccgtcgccagcgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagacgttcgtggagctgatgcgccgcggggacctcccggtgtggctgtcctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcccgcacctacagcgaccccctggccctccgggagttcaaggagttcgcggccggccgccggtccgtcagcggggacctgatcctggagatcggcaagctcccccagcacctgacccagcgcgcccagaacgccctggacaacctcgtgatgctgcacaactccgagcagggcgggcgggcgtaccgccacgccatggaggagctgccggacacgatcgagaccctcatgctgctggccctcatcgccgtgctgaccggcggggtcaccctgttcttcctcagcggccgggggctgggcaagacgtccatcggcctgctctgcgtgatggccagctccgtgctgctgtggatggcgagcgtcgagccccactggatcgccgcctccatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagaccaccaagaaggacctggggatcggccacgtggccgtcgagaaccaccaccacgccgccatgctggacgtggacctccaccccgccagcgcgtggacgctgtacgccgtggccaccaccatcatcacccccatgatgcgccacacgatcgagaacaccaccgccaacatctccctgaccgccatcgcgaaccaggccgccatcctcatggggctggacaagggctggccgatcagcaagatggacatcggcgtccccctgctcgccctggggtgctactcccaggtgaaccccctgacgctcaccgcggccgtgctgatgctggtcgcccactacgccatcatcggccccgggctccaggccaaggcgacccgggaggcccagaagcgcaccgccgccggcatcatgaagaacccgacggtggacgggatcgtggccatcgacctggaccccgtcgtgtacgacgcgaagttcgagaagcagctgggccagatcatgctcctgatcctgtgcaccagccagatcctcctgatgcgcaccacctgggccctgtgcgagtccatcacgctcgccaccggccccctgaccaccctgtgggaggggagccccggcaagttctggaacacgaccatcgccgtgagcatggccaacatcttccgggggtcctacctcgcgggcgccggcctggccttcagcctgatgaagtccctcgggggcgggcgccggggcaccggggcccagggcgagaccctgggcgagaagtggaagcgccagctgaaccagctcagcaagtccgagttcaacacgtacaagcggagcgggatcatggaggtcgaccgctccgaggcgaaggagggcctgaagcgcggggagaccaccaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgacggaggtcaaggggtacaccaagggcgggcccggccacgaggagcccatccccatggccacctacgggtggaacctggtgaagctccacagcggcaaggacgtgttcttcgtcccgcccgagaagtgcgacaccctgctgtgcgacatcggggagtccagccccaaccccacgatcgaggagggccgcaccctccgggtgctgaagatggtggagccgtggctgcgcgggaaccagttctgcatcaagatcctcaacccctacatgccctccgtcgtggagaccctggagcagatgcagcggaagcacggcggcatgctggtgcgcaaccccctcagccggaactccacccacgagatgtactgggtcagctgcgggacgggcaacatcgtgtccgcggtgaacatgaccagccgcatgctgctgaaccggttcaccatggcccaccgcaagccgacctacgagcgcgacgtcgacctcggggccggcacccggcacgtggccgtggagcccgaggtcgccaacctggacatcatcggccagcgcatcgagaacatcaagcacgagcacaagtccacgtggcactacgacgaggacaacccctacaagacctgggcgtaccacgggagctacgaggtgaagcccagcggctccgccagctccatggtcaacggggtggtgaagctgctcaccaagccgtgggacgtcatccccatggtgacccagatcgccatgacggacaccacccccttcggccagcagcgggtgttcaaggagaaggtcgacacccgcacgcccaaggccaagcgggggaccgcccagatcatggaggtgaccgcgaagtggctgtggggcttcctgagccgcaacaagaagccgcggatctgcacccgcgaggagttcacgcggaaggtgcgctccaacgccgccatcggcgccgtcttcgtggacgagaaccagtggaacagcgcgaaggaggccgtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggtcccgggccatctggtacatgtggctcggcgcgcgcttcctggagttcgaggccctgggcttcatgaacgaggaccactggttcagccgggagaactccctcagcggggtggagggcgaggggctgcacaagctgggctacatcctccgcgacatctccaagatcagcgggggcaacatgtacgccgacgacaccgccggctgggacacccggatcacggaggacgacctgcagaacgaggccaagatcaccgacatcatggagcccgagcacgcgctgctcgccaactccatcttcaagctgacctaccagaacaaggtcgtgcgcgtgcagcggcccgccaagaacgggaccgtcatggacgtgatcagccgccgcgaccagcggggctccggccaggtgggcacgtacggcctgaacaccttcaccaacatggaggcccagctcatccgccagatggagagcgaggggatcttctccccgagcgagctggagacccccaacctggccgagcgggtcctcgactggctggagaagcacggcgtggagcgcctgaagcggatggcgatcagcggggacgactgcgtggtcaagcccatcgacgaccgcttcgccacggccctcaccgccctgaacgacatgggcaaggtgcggaaggacatcccccagtgggagccgtccaaggggtggaacgactggcagcaggtccccttctgcagccaccacttccaccagctgatcatgaaggacggccgcgagatcgtcgtgccctgccggaaccaggacgagctcgtgggccgcgcccgggtctcccagggggcgggctggagcctgcgcgagaccgcctgcctggggaagtcctacgcccagatgtggcagctcatgtacttccaccggcgcgacctgcggctggccgcgaacgccatctgcagcgccgtgcccgtggactgggtcccgacctcccgcacgacctggagcatccacgcccaccaccagtggatgaccaccgaggacatgctctccgtgtggaaccgggtgtggatcgaggagaacccctggatggaggacaagacgcacatcagctcctgggaggacgtcccctacctgggcaagcgcgaggaccagtggtgcgggagcctgatcggcctcaccgcccgggcgacctgggccaccaacatccaggtggccatcaaccaggtgcgccgcctgatcggcaacgagaactacctggactacatgacgtccatgaagcggttcaagaacgagagcgaccccgagggggccctctggtga

SEQ ID NO: 8042 - RNA, 9879 nt, synthetic construct
  misc_feature 1..9879: note = derived and/or modified CDS sequence (opt1) from DENV-1__HM488255__SS-prME
  source 1..9879: mol_type = other RNA
agcgtgaccatgctgctcatgctgatgcccaccgccctggccttccacctcaccacccgcggcggggagccccacatgatcgtgtccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagagcgcctggaagcagatccagcgggtcgagacctgggccctccgccaccccggcttcacggtgatcgccctgttcctggcgcacgccatcgggacctccatcacccagaagggcatcatcttcatcctcctgatgctggtgacccccagcatggccatgcggtgcgtcgggatcggctcccgcgacttcgtggagggcctcagcggggccacgtgggtggacgtcgtgctggagcacggctcctgcgtgaccaccatggccaaggacaagcccaccctggacatcgagctcctgaagacggaggtcaccaaccccgcgatcctgcggaagctctgcatcgaggccaagatcagcaacaccaccacggactcccgctgcccgacccagggggaggccaccctggtggaggagcaggacgccaacttcgtgtgccggcgcaccttcgtcgaccggggctggggcaacgggtgcggcctgttcgggaagggcagcctcatcacgtgcgccaagttcaagtgcgtgaccaagctggaggggaagatcgtgcagtacgagaacctgaagtactccgtcatcgtgaccgtgcacaccggcgaccagcaccaggtcggcaacgagagcacggagcacgggaccaccgcgaccatcacgccccaggcccccacgaccgagatccagctcaccgactacggcgccctgaccctggactgcagcccccggacggggctcgacttcaacgagatggtgctgctgaccatgaaggagaagtcctggctcgtccacaagcagtggttcctggacctgcccctcccctggaccagcggcgcctccaccagccaggagacgtggaaccggcaggacctgctggtgaccttcaagaccgcccacgcgaagaagcaggaggtggtcgtgctcgggtcccaggagggcgccatgcacaccgccctgacgggcgccaccgagatccagaccagcgggaccacgaccatcttcgccggccacctgaagtgccgcctcaagatggacaagctgaccctgaaggggatgtcctacgtgatgtgcaccggcagcttcaagctcgagaaggaggtcgcggagacgcagcacgggaccgtgctggtgcagatcaagtacgagggcaccgacgccccctgcaagatccccttctccacccaggacgagaagggcgtcacgcagaacgggcggctgatcaccgccaacccgatcgtgaccgacaaggagaagcccgtgaacatcgaggccgagccgcccttcggcgagagctacatcgtcatcggggcgggcgagaaggccctgaagctctcctggttcaagaagggcagctccatcgggaagatgttcgaggccaccgcccgcggcgcccggcgcatggcgatcctgggggacacggcctgggacttcggcagcatcgggggcgtgttcacctccgtgggcaagctggtccaccagatcttcgggaccgcctacggcgtcctcttcagcggggtgtcctggaccatgaagatcggcatcggggtcctgctgacgtggctcggcctgaacagccgctccaccagcctgtccatgacctgcatcgccgtgggcctcgtgaccctgtacctgggggtcatggtgcaggccgacagcggctgcgtgatcaactggaaggggcgggagctcaagtgcggcagcgggatcttcgtcacgaacgaggtgcacacctggaccgagcagtacaagttccaggcggactccccgaagcgcctgagcgccgccatcggcaaggcctgggaggagggcgtgtgcgggatccggtccgccacccgcctggagaacatcatgtggaagcagatcagcaacgagctcaaccacatcctgctggagaacgacatgaagttcaccgtcgtggtgggcgacgtcgcggggatcctcgcccagggcaagaagatgatccggccccagcccatggagtacaagtactcctggaagtcctgggggaaggccaagatcatcggcgccgacgtgcagaacacgaccttcatcatcgacggccccaacaccccggagtgccccgacgaccagcgcgcgtggaacatctgggaggtggaggactacgggttcggcatcttcaccacgaacatctggctgaagctgcgggactcctacacccaggtctgcgaccaccgcctcatgagcgccgccatcaaggactccaaggccgtgcacgccgacatggggtactggatcgagagcgagaagaacgagacctggaagctggcgcgggcctccttcatcgaggtgaagacctgcatctggcccaagagccacacgctgtggtccaacggcgtcctcgagagcgagatgatcatccccaagatctacggcgggccgatctcccagcacaactaccgccccggctacttcacccagaccgccgggccctggcacctgggcaagctggagctcgacttcgacctgtgcgaggggaccacggtggtggtcgacgagcactgcggcaaccggggcccgagcctgcgcaccaccaccgtgacggggaagatcatccacgagtggtgctgccggtcctgcaccctgccgcccctccgcttccggggcgaggacgggtgctggtacggcatggagatccgccccgtgaaggagaaggaggagaacctggtcaagagcatggtgagcgccgggtccggcgaggtggacagcttctccctcggcctgctgtgcatcagcatcatgatcgaggaggtcatgcggtcccgctggagccggaagatgctcatgaccgggaccctggccgtgttcctgctcctgatcatgggccagctgacgtggaacgacctcatccgcctgtgcatcatggtgggggcgaacgcctccgaccgcatgggcatggggaccacctacctggccctcatggccaccttcaagatgcggccgatgttcgccgtcgggctgctgttccgccggctcacgagccgcgaggtgctgctgctcaccatcggcctgtccctggtggcgagcgtcgagctccccaactccctggaggagctgggggacggcctcgccatggggatcatgatcctgaagctgctcaccgacttccagagccaccagctgtgggccaccctgctctccctgacgttcatcaagaccaccttcagcctgcactacgcctggaagaccatggcgatggtgctctccatcgtcagcctgttccccctgtgcctctccacgaccagccagaagaccacctggctgcccgtgctgctcggctccctgggctgcaagccgctgacgatgttcctcatcgccgagaacaagatctgggggcggcgcagctggcccctgaacgagggcatcatggccgtggggatcgtcagcatcctgctctccagcctgctgaagaacgacgtgcccctcgccggccccctgatcgccgggggcatgctgatcgcgtgctacgtgatctccggcagctccgccgacctcagcctggagaaggccgccgaggtctcctgggaggaggaggccgagcacagcggggcgtcccacaacatcctggtggaggtgcaggacgacggcaccatgaagatcaaggacgaggagcgggacgacaccctcaccatcctgctgaaggccaccctcctggccgtcagcggggtgtacccgctgtccatccccgccaccctcttcgtgtggtacttctggcagaagaagaagcagcgcagcggcgtcctgtgggacacccccagcccgcccgaggtggagcgggccgtgctggacgacgggatctaccgcatcatgcagcggggcctgctcggccgcagccaggtcggggtgggcgtgttccaggagaacgtcttccacaccatgtggcacgtgacccgcggggcggtgctgatgtaccagggcaagcgcctggagccctcctgggccagcgtcaagaaggacctcatctcctacgggggcggctggcggctgcaggggagctggaacacgggcgaggaggtccaggtgatcgccgtcgagcccgggaagaaccccaagaacgtgcagaccgcccccggcaccttcaagacccccgagggggaggtgggcgccatcgcgctggacttcaagcccggcacgtccgggagccccatcgtcaaccgcgagggcaagatcgtggggctctacggcaacggcgtggtcaccaccagcgggacctacgtgtccgccatcgcccaggccaaggcgagccaggagggcccgctgcccgagatcgaggacgaggtgttccggaagcgcaacctgacgatcatggacctccaccccgggtccggcaagacccggcgctacctgccggccatcgtccgggaggccatcaagcgcaagctgcgcaccctcatcctggcccccacccgggtggtggccagcgagatggcggaggccctgaaggggatgcccatccgctaccagacgaccgccgtcaagtccgagcacaccggcaaggagatcgtggacctcatgtgccacgccaccttcacgatgcggctgctgagccccgtgcgcgtcccgaactacaacatgatcatcatggacgaggcccacttcaccgacccctccagcatcgcggcccggggctacatctccacccgcgtggggatgggcgaggccgccgccatcttcatgaccgcgacgccgcccgggagcgtggaggccttcccgcagtccaacgccgtcatccaggacgaggagcgggacatccccgagcgcagctggaactccggctacgagtggatcaccgacttccccgggaagaccgtgtggttcgtgcccagcatcaagtccggcaacgacatcgccaactgcctccggaagaacggcaagcgcgtcatccagctgagccggaagaccttcgacacggagtaccagaagaccaagaacaacgactgggactacgtggtgaccaccgacatctccgagatgggggcgaacttccgcgccgaccgggtcatcgacccgcgccggtgcctgaagcccgtgatcctcaaggacggccccgagcgcgtgatcctggccgggcccatgccggtcacggtggccagcgccgcgcagcggcgcggccggatcgggcgcaaccacaacaaggagggcgaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcgatcgacggcgagtaccggctccgcggggaggcccggaagaccttcgtcgagctgatgcgccggggcgacctgcccgtgtggctcagctacaaggtggccagcgaggggttccagtactccgaccgccggtggtgcttcgacggcgagcgcaacaaccaggtcctggaggagaacatggacgtggagatctggacgaaggagggcgagcggaagaagctgcgcccccggtggctcgacgcccgcacctacagcgaccccctggccctgcgggagttcaaggagttcgcggccgggcgccggtccgtgagcggcgacctcatcctggagatcgggaagctgccgcagcacctcacccagcgcgcccagaacgccctggacaacctggtcatgctccacaactccgagcagggcggccgggcgtaccgccacgccatggaggagctgcccgacaccatcgagacgctgatgctcctggccctgatcgccgtgctcaccgggggcgtgaccctgttcttcctgagcgggcggggcctcgggaagacctccatcggcctgctgtgcgtcatggccagctccgtgctcctgtggatggcgagcgtggagccccactggatcgccgcctccatcatcctggagttcttcctcatggtcctgctgatccccgagccggaccgccagcggacgccccaggacaaccagctcgcctacgtggtgatcggcctgctgttcatgatcctcacggtcgccgcgaacgagatggggctgctggagaccaccaagaaggacctcggcatcgggcacgtggccgtgggcaaccaccaccacgccgccatgctggacgtcgacctgcaccccgccagcgcgtggaccctctacgccgtggccacgaccatcatcaccccgatgatgcgccacaccatcgagaacacgaccgccaacatctccctgaccgccatcgcgaaccaggccgccatcctgatggggctcgacaagggctggcccatcagcaagatggacatcggcgtgcccctgctggccctcgggtgctactcccaggtcaaccccctgaccctgacggcggccgtgctcatgctggtggcccactacgccatcatcggcccggggctgcaggccaaggcgacccgcgaggcccagaagcggaccgccgccggcatcatgaagaaccccaccgtcgacgggatcgtggccatcgacctcgaccccgtggtctacgacgcgaagttcgagaagcagctgggccagatcatgctgctcatcctgtgcacgagccagatcctgctcatgcgcaccacctgggccctgtgcgagtccatcaccctggccacgggccccctcaccaccctgtgggaggggagcccgggcaagttctggaacaccacgatcgccgtgtccatggccaacatcttccgggggagctacctggcgggcgccggcctcgccttcagcctgatgaagtccctggggcgcggccggcgcgggaccggcgcccagggggagaccctcggcgagaagtggaagcggcagctgaaccagctgagcaagtccgagttcaacacctacaagcgcagcggcatcatggaggtggaccggtccgaggcgaaggaggggctcaagcgcggcgagacgaccaagcacgccgtcagccgggggaccgccaagctgcgctggttcgtggagcggaacctggtgaagcccgagggcaaggtcatcgacctggggtgcggccgcggcgggtggtcctactactgcgccggcctcaagaaggtgaccgaggtgaaggggtacacgaagggcgggcccggccacgaggagcccatcccgatggccacctacggctggaacctggtcaagctgcacagcgggaaggacgtgttcttcatcccgcccgagaagtgcgacaccctcctgtgcgacatcggcgagtccagccccaacccgaccatcgaggaggggcggacgctgcgcgtgctcaagatggtcgagccctggctgcggggcaaccagttctgcatcaagatcctgaacccctacatgccctccgtggtggagaccctcgagcagatgcagcgcaagcacgggggcatgctggtccggaacccgctgagccgcaactccacccacgagatgtactgggtgagctgcggcaccgggaacatcgtgtccgcggtcaacatgaccagccgcatgctcctgaaccggttcacgatggcccaccgcaagcccacctacgagcgggacgtggacctgggcgccgggacccgccacgtggccgtcgagcccgaggtggccaacctcgacatcatcggccagcggatcgagaacatcaagcacgagcacaagtccacctggcactacgacgaggacaacccctacaagacgtgggcgtaccacggcagctacgaggtgaagccgtccgggagcgccagctccatggtcaacggcgtggtcaagctgctgaccaagccctgggacgtgatccccatggtgacccagatcgccatgaccgacacgacccccttcgggcagcagcgcgtcttcaaggagaaggtggacacccggaccccgaaggccaagcgcggcacggcccagatcatggaggtgaccgcgaagtggctctgggggttcctgagccggaacaagaagccccgcatctgcacccgggaggagttcacccgcaaggtccggtccaacgccgccatcggcgccgtgttcgtggacgagaaccagtggaacagcgcgaaggaggccgtcgaggacgagcgcttctgggacctggtgcaccgggagcgcgagctccacaagcagggcaagtgcgccacgtgcgtgtacaacatgatggggaagcgggagaagaagctgggcgagttcgggaaggccaagggctcccgcgccatctggtacatgtggctgggggcgcggttcctcgagttcgaggccctgggcttcatgaacgaggaccactggttcagccgcgagaactccctgagcggcgtcgagggggagggcctccacaagctggggtacatcctgcgggacatctccaagatccccggcgggaacatgtacgccgacgacaccgccggctgggacacccgcatcaccgaggacgacctccagaacgaggcccgcatcacggacatcatggagccggagcacgcgctgctggccaagagcatcttcaagctcacctaccagaacaaggtggtgcgggtccagcgccccgccaagaacggcaccgtgatggacgtgatctcccggcgcgaccagcgggggagcggccaggtcgggacctacggcctgaacacgttcaccaacatggaggcccagctgatccgccagatggagtccgagggcatcttcagcccctccgagctcgagacccccaacctggccgagcgggtgctggactggctcgagaagtacggggtggagcgcctgaagcggatggcgatcagcggcgacgactgcgtcgtgaagccgatcgacgaccgcttcgccaccgccctgacggccctcaacgacatggggaaggtgcggaaggacatcccccagtgggagccctccaagggctggaacgactggcagcaggtccccttctgcagccaccacttccaccagctgatcatgaaggacgggcgcgagatcgtggtgccgtgccggaaccaggacgagctggtcggccgcgcccgggtgagccagggcgcggggtggtccctccgcgagaccgcctgcctgggcaagagctacgcccagatgtggcagctgatgtacttccaccggcgcgacctccggctggccgcgaacgccatctgctccgccgtgcccgtcgactggatccccaccagccgcaccacgtggtccatccacgcccaccaccagtggatgaccaccgaggacatgctgagcgtgtggaaccgcgtgtggatcgaggagaacccctggatggaggacaagacccacatctccagctggggcgacgtcccgtacctcggcaagcgggaggaccagtggtgcgggtccctgatcggcctgacggcccgcgcgacctgggccaccaacatccaggtggccatcaaccaggtgcggcgcctcatcggcaacgagaactacctggactacatgaccagcatgaagcggttcaagaacgagtccgaccccgagggggccctgtggtga

SEQ ID NO: 8043 - RNA, 9879 nt, synthetic construct
  misc_feature 1..9879: note = derived and/or modified CDS sequence (opt1) from DENV-1__HM181944__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcagcgaggccgagcccgacgacgtggactgctggtgcaacgccaccgacacctgggtgacctacgggacctgctcccagaccggcgagcaccggcgcgacaagcggagcgtggccctcgcgccccacgtgggcctggggctggagacccggacggagacctggatgtccagcgagggcgcctggaagcagatccagcgggtcgagacctgggccctccgccaccccgggttcaccgtgatcgccctgttcctggcgcacgccatcggcacgtccatcacccagaaggggatcatcttcatcctcctgatgctggtgacccccagcatggccatgcggtgcgtcggcatcggctcccgcgacttcgtggaggggctcagcggcgccacctgggtggacgtcgtgctggagcacgggtcctgcgtgacgaccatggccaaggacaagcccaccctggacatcgagctcctgaagaccgaggtcacgaaccccgcggtgctgcggaagctctgcatcgaggccaagatcagcaacaccaccaccgactcccgctgcccgacgcagggcgaggccaccctggtggaggagcaggacgccaacttcgtctgccggcgcaccttcgtggaccggggctgggggaacggctgcgggctgttcggcaaggggagcctcatcacgtgcgccaagttcaagtgcgtgacgaagctggagggcaagatcgtccagtacgagaacctgaagtactccgtgatcgtgaccgtccacaccggcgaccagcaccaggtggggaacgagagcaccgagcacggcacgaccgcgaccatcacgccccaggccccctccaccgagatccagctcacggactacggggccctgaccctggactgcagcccccgcaccggcctcgacttcaacgagatggtcctgctgaccatgaaggagaagtcctggctcgtgcacaagcagtggttcctggacctgccgctcccctggacgtccggggccagcacctcccaggagacctggaaccggcaggacctgctggtgaccttcaagacggcccacgcgaagaagcaggaggtcgtggtgctcggcagccaggagggcgccatgcacaccgccctgaccggggccaccgagatccagacgtccggcaccaccaccatcttcgccgggcacctgaagtgccgcctcaagatggacaagctgacgctgaagggcatgagctacgtcatgtgcaccgggtccttcaagctcgagaaggaggtggcggagacccagcacggcaccgtgctggtccagatcaagtacgagggcacggacgccccctgcaagatccccttcagcacccaggacgagaagggggtgacccagaacggccggctgatcaccgccaacccgatcgtgacggacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccatcggcggcgtgttcaccagcgtcgggaagctggtgcaccagatcttcggcacggcctacggggtgctgttctccggcgtcagctggaccatgaagatcgggatcggcgtgctgctgacctggctcggcctgaactcccgcagcacctccctgagcatgacgtgcatcgccgtggggctcgtcaccctgtacctgggcgtgatggtgcaggccgacagcgggtgcgtcatcaactggaagggccgggagctcaagtgcgggtccggcatcttcgtgaccaacgaggtgcacacctggacggagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagtacaagtacagctggaagtcctggggcaaggccaagatcatcggcgccgacgtgcagaacaccaccttcatcatcgacgggcccaacacgccggagtgccccgacgaccagcgcgcgtggaacatctgggaggtcgaggactacggcttcgggatcttcaccaccaacatctggctgaagctgcgggacagctacacccaggtgtgcgaccaccgcctcatgtccgccgccatcaaggacagcaaggccgtgcacgccgacatgggctactggatcgagtccgagaagaacgagacgtggaagctggcgcgggccagcttcatcgaggtcaagacctgcatctggcccaagtcccacaccctgtggagcaacggcgtgctcgagtccgagatgatcatccccaagatctacgggggcccgatcagccagcacaactaccgccccgggtacttcacccagacggccggcccctggcacctggggaagctggagctcgacttcgacctgtgcgagggcaccaccgtggtcgtggacgagcactgcggcaaccgggggccgtccctgcgcaccacgaccgtgaccggcaagatcatccacgagtggtgctgccggagctgcaccctgccgcccctccgcttcaagggggaggacggctgctggtacgggatggagatccggcccgtcaaggagaaggaggagaacctggtcaagagcatggtgtccgccggcagcggcgaggtcgactccttcagcctcgggctgctgtgcatctccatcatgatcgaggaggtgatgcgcagccggtggtcccgcaagatgctcatgacgggcaccctggccgtgttcttcctgctcatcatggggcagctgacctggaacgacctgatccggctctgcatcatggtcggcgcgaacgccagcgaccgcatggggatgggcatgacctacctggccctgatggccacgttcaagatgcgcccgatgttcgccgtgggcctcctgttccggcgcctgacctcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccacgctgctgagcctcaccttcatcaagaccaccttctccctgcactacgcctggaagacgatggcgatggtcctgagcatcgtgtccctcttccccctgtgcctgagcaccacctcccagaagaccacgtggctccccgtgctgctgggcagcctcgggtgcaagccgctgaccatgttcctgatcgccgagaacaagatctggggccgcaagagctggcccctcaacgaggggatcatggccgtcggcatcgtgtccatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgggacgacaccctgacgatcctcctgaaggccaccctgctcgccgtgtccggcgtgtacccgctgagcatccccgccaccctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacgcggggcgcggtcctcatgtaccaggggaagcgcctggagcccagctgggcctccgtgaagaaggacctgatcagctacggcggcgggtggcggctccagggctcctggaacaccggggaggaggtgcaggtcatcgccgtggagcccggcaagaaccccaagaacgtgcagaccgcccccgggaccttcaagacgagcgagggcgaggtcggcgccatcgcgctggacttcaagcccgggaccagcggctcccccatcgtgaaccgcgaggggaagatcgtgggcctgtacggcaacggggtcgtgaccaccagcggcacgtacgtgtccgccatcgcccaggccaaggcgagccaggaggggcccctcccggagatcgaggacgaggtcttccggaagcgcaacctgaccatcatggacctgcaccccggctccgggaagacccggcgctacctccccgccatcgtgcgggaggccatcaagcgcaagctgcggaccctgatcctcgccccgacgcgcgtggtcgccagcgagatggcggaggccctgaagggcatgcccatccgctaccagaccaccgccgtgaagtccgagcacaccggcaaggagatcgtggacctgatgtgccacgccacgttcaccatgcggctcctgagccccgtccgcgtgcccaactacaacatgatcatcatggacgaggcccacttcaccgacccgtccagcatcgcggcccgggggtacatctccacccgcgtgggcatgggggaggccgccgccatcttcatgacggcgacgccgcccggcagcgtcgaggccttcccccagtccaacgccgtgatccaggacgaggagcgggacatcccggagcgcagctggaactccgggtacgagtggatcaccgacttccccggcaagaccgtgtggttcgtccccagcatcaagtccggcaacgacatcgccaactgcctgcggaagaacgggaagcgcgtgatccagctcagccggaagacgttcgacaccgagtaccagaagaccaagaacaacgactgggactacgtggtcaccacggacatctccgagatgggcgcgaacttccgcgccgaccgggtgatcgacccccgccggtgcctgaagccggtgatcctgaaggacgggcccgagcgcgtcatcctcgccggccccatgcccgtgaccgtcgccagcgccgcgcagcggcgcgggcggatcggccgcaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgggagaagtccgccgcgatcgacggggagtaccgcctgcgcggcgaggcccggaagacgttcgtggagctcatgcgccgcggggacctgccggtgtggctgtcctacaaggtcgccagcgagggcttccagtactccgaccgccggtggtgcttcgacggcgagcgcaacaaccaggtgctcgaggagaacatggacgtggagatctggaccaaggagggggagcggaagaagctgcgcccccggtggctggacgcccgcacctacagcgaccccctcgccctgcgggagttcaaggagttcgcggccggccgccggtccgtcagcggggacctgatcctcgagatcggcaagctgccccagcacctgacccagcgcgcccagaacgccctcgacaacctggtgatgctgcacaactccgagcagggcgggcgggcgtaccgccacgccatggaggagctcccggacacgatcgagaccctgatgctgctcgccctgatcgccgtgctgaccggcggggtcaccctcttcttcctgagcggccgggggctgggcaagacgtccatcggcctcctgtgcgtgatggccagctccgtgctgctctggatggcgagcgtcgagccccactggatcgccgcctccatcatcctggagttcttcctgatggtgctcctgatccccgagcccgaccgccagcggaccccgcaggacaaccagctggcctacgtggtcatcgggctcctgttcatgatcctgaccgtggccgcgaacgagatgggcctcctggagaccaccaagaaggacctggggatcggccacgtggccgtcgagaaccaccaccacgccgccatgctcgacgtggacctgcaccccgccagcgcgtggacgctgtacgccgtggccaccaccatcatcacccccatgatgcgccacacgatcgagaacaccaccgccaacatctccctcaccgccatcgcgaaccaggccgccatcctgatggggctggacaagggctggccgatcagcaagatggacatcggcgtccccctcctggccctggggtgctactcccaggtgaaccccctcacgctgaccgcggccgtgctgatgctcgtcgcccactacgccatcatcggccccgggctgcaggccaaggcgacccgggaggcccagaagcgcaccgccgccggcatcatgaagaacccgacggtggacgggatcgtggccatcgacctggaccccgtcgtgtacgacgcgaagttcgagaagcagctcggccagatcatgctgctgatcctctgcaccagccagatcctgctgatgcgcaccacctgggccctctgcgagtccatcacgctggccaccggccccctgaccaccctctgggaggggagccccggcaagttctggaacacgaccatcgccgtgagcatggccaacatcttccgggggtcctacctggcgggcgccggcctggccttcagcctcatgaagtccctcgggggcgggcgccgggggaccggggcccagggcgagaccctgggcgagaagtggaagcgccagctcaaccagctgagcaagtccgagttcaacacgtacaagcggagcgggatcatggaggtcgaccgctccgaggcgaaggagggcctgaagcgcggggagaccaccaagcacgccgtgagccgcggcaccgccaagctccggtggttcgtggagcgcaacctggtcaagccggaggggaaggtgatcgacctgggctgcggccgcggcgggtggtcctactactgcgccgggctgaagaaggtgacggaggtcaaggggtacaccaagggcggccccggccacgaggagcccatccccatggccacctacgggtggaacctcgtgaagctgcacagcggcaaggacgtgttcttcgtcccgcccgagaagtgcgacaccctgctctgcgacatcggggagtccagccccaaccccacgatcgaggagggccgcaccctgcgggtgctgaagatggtggagccgtggctccgcgggaaccagttctgcatcaagatcctgaacccctacatgccctccgtcgtggagaccctggagcagatgcagcggaagcacggcggcatgctcgtgcgcaaccccctgagccggaactccacccacgagatgtactgggtcagctgcgggacgggcaacatcgtgtccgcggtgaacatgaccagccgcatgctgctcaaccggttcaccatggcccaccgcaagccgacctacgagcgcgacgtcgacctgggggccggcacccggcacgtggccgtggagcccgaggtcgccaacctggacatcatcggccagcgcatcgagaacatcaagcacgagcacaagtccacgtggcactacgacgaggacaacccctacaagacctgggcgtaccacgggagctacgaggtgaagcccagcggctccgccagctccatggtcaacggggtggtgaagctcctgaccaagccgtgggacgtcatccccatggtgacccagatcgccatgacggacaccacccccttcggccagcagcgggtgttcaaggagaaggtcgacacccgcacgcccaaggccaagcgggggaccgcccagatcatggaggtgaccgcgaagtggctgtggggcttcctcagccgcaacaagaagccgcggatctgcacccgcgaggagttcacgcggaaggtgcgctccaacgccgccatcggcgccgtcttcgtggacgagaaccagtggaacagcgcgaaggaggccgtggaggacgagcggttctgggacctggtccaccgcgagcgggagctgcacaagcaggggaagtgcgcgacctgcgtgtacaacatgatgggcaagcgcgagaagaagctcggggagttcggcaaggccaaggggtcccgggccatctggtacatgtggctgggcgcgcgcttcctggagttcgaggccctcggcttcatgaacgaggaccactggttcagccgggagaactccctgagcggggtggagggcgaggggctgcacaagctcggctacatcctgcgcgacatctccaagatcagcgggggcaacatgtacgccgacgacaccgccggctgggacacccggatcacggaggacgacctgcagaacgaggccaagatcaccgacatcatggagcccgagcacgcgctcctggccaactccatcttcaagctgacctaccagaacaaggtcgtgcgcgtgcagcggcccgccaagaacgggaccgtcatggacgtgatcagccgccgcgaccagcggggctccggccaggtgggcacgtacggcctcaacaccttcaccaacatggaggcccagctgatccgccagatggagagcgaggggatcttctccccgagcgagctggagacccccaacctcgccgagcgggtcctggactggctggagaagcacggcgtggagcgcctcaagcggatggcgatcagcggggacgactgcgtggtcaagcccatcgacgaccgcttcgccacggccctgaccgccctgaacgacatgggcaaggtgcggaaggacatcccccagtgggagccgtccaaggggtggaacgactggcagcaggtccccttctgcagccaccacttccaccagctcatcatgaaggacggccgcgagatcgtcgtgccctgccggaaccaggacgagctggtgggccgcgcccgggtctcccagggggcgggctggagcctgcgcgagaccgcctgcctcgggaagtcctacgcccagatgtggcagctgatgtacttccaccggcgcgacctgcggctcgccgcgaacgccatctgcagcgccgtgcccgtggactgggtcccgacctcccgcacgacctggagcatccacgcccaccaccagtggatgaccaccgaggacatgctgtccgtgtggaaccgggtgtggatcgaggagaacccctggatggaggacaagacgcacatcagctcctgggaggacgtcccctacctgggcaagcgcgaggaccagtggtgcgggagcctcatcggcctgaccgcccgggcgacctgggccaccaacatccaggtggccatcaaccaggtgcgccgcctgatcggcaacgagaactacctcgactacatgacgtccatgaagcggttcaagaacgagagcgaccccgagggggccctgtggtga

SEQ ID NO: 8044 - RNA, 9879 nt, synthetic construct
  misc_feature 1..9879: note = derived and/or modified CDS sequence (opt1) from DENV-1__HM181946__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgccccacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatccggtacgagggcaccgacgccccctgcaagatccccttcagcacccaggacgagcgcggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccgccggatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccttcagcatgacctgcatcgccgtggggctggtgaccctctacctgggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctctccgccgccatcggcaaggcctgggaggagggggtgtgcggcatccggagcgccacccgcctggagaacatcatgtggaagcagatctccaacgagctgaaccacatcctcctggagaacgacatgaagttcaccgtcgtggtgggggacgtcgcgggcatcctggcccaggggaagaagatgatccggccccagcccatggagtacaagtacagctggcgctcctggggcaaggccaagatcatcggcgccgacgtgcagaacacgaccttcatcatcgacgggcccaacaccccggagtgccccgacgaccagcgggcgtggaacatctgggaggtggaggactacggcttcgggatcttcaccacgaacatctggctcaagctgcgcgacagctacacccaggtctgcgaccaccggctgatgtccgccgccatcaaggacagcaaggccgtgcacgccgacatgggctactggatcgagtccgagaagaacgagacctggaagctcgcgcgcgccagcttcatcgaggtgaagacctgcatctggcccaagtcccacacgctgtggagcaacggcgtcctggagtccgagatgatcatccccaagatctacgggggcccgatcagccagcacaactaccggcccgggtacttcacccagaccgccggcccctggcacctcgggaagctggagctggacttcgacctctgcgagggcaccacggtggtggtcgacgagcactgcggcaaccgcgggccgtccctgcggaccaccaccgtgacgggcaagatcatccacgagtggtgctgccgcagctgcaccctgccgcccctccggttccgcggggaggacggctgctggtacgggatggagatccggcccgtgaaggagaaggaggagaacctggtcaagtccatggtgagcgccggcagcggcgaggtggactccttcagcctggggctcctgtgcatctccatcatgatcgaggaggtcatgcgcagccgctggtcccggaagatgctgatgaccggcaccctcgccgtgttcctgctgctcatcatggggcagctgacgtggaacgacctgatccgcctctgcatcatggtgggcgcgaacgccagcgaccggatggggatgggcaccacctacctggccctgatggccaccttcaagatgcgcccgatgttcgccgtcgggctcctgttccggcgcctgacgtcccgggaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtgctgagcatcgtctccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgcgacgacaccctgaccatcctcctgaaggccaccctgctcgccgtctccggcgtgtacccgctgagcatccccgccacgctgttcgtgtggtacttctggcagaagaagaagcagcggtccggggtcctctgggacacccccagcccgcccgaggtggagcgcgccgtgctggacgacggcatctaccggatcatgcagcgcggcctgctggggcggtcccaggtcggcgtgggggtgttccaggagaacgtcttccacaccatgtggcacgtgacccgcggcgcggtgctcatgtaccaggggaagcggctggagcccagctgggcctccgtcaagaaggacctgatcagctacggcggcgggtggcgcctccagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgggaggggaagatcgtgggcctgtacggcaacggggtggtcaccaccagcggcacctacgtgagcgccatcgcccaggccaaggcgtcccaggaggggccgctccccgagatcgaggacgaggtgttccgcaagcggaacctgacgatcatggacctgcaccccggcagcgggaagacccgccgctacctcccggccatcgtccgggaggccatcaagcgcaagctgcggaccctgatcctcgcccccacccgcgtggtggcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtgcgggtcccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagaccttcgacacggagtaccagaagaccaagaacaacgactgggactacgtggtgaccaccgacatcagcgagatgggcgcgaacttccgggccgaccgcgtcatcgacccgcggcgctgcctgaagcccgtgatcctgaaggacgggcccgagcgggtgatcctcgccggccccatgccggtcacggtggcctccgccgcgcagcgccgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtgtccggggacctgatcctcgagatcggcaagctgccgcagcacctgacccagcgggcccagaacgccctcgacaacctggtcatgctgcacaacagcgagcagggcgggcgcgcgtaccggcacgccatggaggagctccccgacaccatcgagacgctgatgctgctcgccctgatcgccgtgctgaccggcggggtgaccctcttcttcctgtccggccgcgggctgggcaagaccagcatcggcctcctgtgcgtcatggcctccagcgtgctgctctggatggcgtccgtggagccccactggatcgccgccagcatcatcctggagttcttcctgatggtcctcctgatccccgagccggaccgccagcggacgccccaggacaaccagctggcctacgtggtgatcgggctcctgttcatgatcctgacggtcgccgcgaacgagatgggcctcctggagaccaccaagaaggacctggggatcggccacgtggccgtggggaaccaccaccacgccgccatgctcgacgtcgacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatgggcctggacaagggctggcccatctccaagatggacatcggggtgcccctcctggccctgggctgctacagccaggtcaaccccctcaccctgacggcggccgtgctgatgctcgtggcccactacgccatcatcgggccgggcctgcaggccaaggcgacccgggaggcccagaagcgcaccgccgccgggatcatgaagaaccccaccgtcgacggcatcgtggccatcgacctggaccccgtggtctacgacgcgaagttcgagaagcagctcggccagatcatgctgctgatcctctgcacgtcccagatcctgctgatgcggaccacctgggccctctgcgagagcatcaccctggccacggggcccctgaccaccctctgggagggctccccggggaagttctggaacaccacgatcgccgtgagcatggccaacatcttccgcggctcctacctggcgggcgccgggctggccttcagcctcatgaagtccctgggcgggggccggcgcgggaccggcgcccagggcgagaccctgggggagaagtggaagcggcagctcaaccagctgtccaagagcgagttcaacacctacaagcgctccggcatcatggaggtggaccggagcgaggcgaaggaggggctgaagcgcggcgagacgaccaagcacgccgtctcccgggggaccgccaagctccgctggttcgtggagcggaacctggtgaagcccgagggcaaggtcatcgacctgggctgcgggcgcggcgggtggagctactactgcgccggcctgaagaaggtgaccgaggtgaaggggtacacgaagggcggccccgggcacgaggagcccatcccgatggccacctacggctggaacctcgtcaagctgcactccgggaaggacgtgttcttcgtgccgcccgagaagtgcgacaccctgctctgcgacatcggcgagagctcccccaacccgaccatcgaggaggggcggacgctgcgcgtcctgaagatggtggagccctggctccggggcaaccagttctgcatcaagatcctgaacccctacatgcccagcgtggtcgagaccctggagcagatgcagcgcaagcacggcgggatgctcgtgcgcaacccgctgtcccggaacagcacccacgagatgtactgggtgtcctgcggcaccgggaacatcgtcagcgcggtgaacatgacctcccgcatgctgctcaaccggttcacgatggcccaccgcaagcccacctacgagcgggacgtggacctgggcgccggcacccgccacgtcgccgtggagcccgaggtggccaacctggacatcatcgggcagcggatcgagaacatcaagcacgagcacaagagcacctggcactacgacgaggacaacccctacaagacgtgggcgtaccacggctcctacgaggtcaagccgagcgggtccgccagcagcatggtgaacggcgtcgtgaagctcctgaccaagccctgggacgtgatccccatggtcacccagatcgccatgaccgacacgacccccttcgggcagcagcgcgtgttcaaggagaaggtggacacccggaccccgaaggccaagcgcggcacggcccagatcatggaggtcaccgcgaagtggctgtggggcttcctctcccggaacaagaagccccgcatctgcacccgggaggagttcacccgcaaggtgcggagcaacgccgccatcggggccgtgttcgtcgacgagaaccagtggaactccgcgaaggaggccgtggaggacgagcgcttctgggacctggtgcaccgggagcgcgagctgcacaagcagggcaagtgcgccacgtgcgtctacaacatgatggggaagcgggagaagaagctcggcgagttcgggaaggccaagggcagccgcgccatctggtacatgtggctgggcgcgcggttcctggagttcgaggccctcgggttcatgaacgaggaccactggttctcccgcgagaacagcctgtccggcgtggagggggagggcctgcacaagctcgggtacatcctgcgcgacatcagcaagatccccggcggcaacatgtacgccgacgacaccgccgggtgggacacccggatcaccgaggacgacctgcagaacgaggcccgcatcacggacatcatggagccggagcacgcgctcctggccaagtccatcttcaagctgacctaccagaacaaggtggtccgggtgcagcgccccgccaagaacggcaccgtgatggacgtcatcagccggcgcgaccagcgggggtccggccaggtgggcacctacgggctcaacacgttcaccaacatggaggcccagctgatccgccagatggagagcgagggcatcttctcccccagcgagctggagacccccaacctcgccgagcgggtgctggactggctggagaagtacggggtcgagcgcctcaagcggatggcgatctccggcgacgactgcgtggtgaagccgatcgacgaccgcttcgccaccgccctgacggccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgcggggtggagcctgcgcgagaccgcctgcctcggcaagtcctacgcccagatgtggcagctgatgtacttccaccggcgcgacctgcgcctcgccgcgaacgccatctgcagcgccgtccccgtggactggatccccacctcccggaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctgggcaagcgggaggaccagtggtgcggcagcctcatcgggctgacggcccgcgcgacctgggccaccaacatccaggtggccatcaaccaggtccggcgcctgatcggcaacgagaactacctcgactacatgacctccatgaagcggttcaagaacgagagcgaccccgagggggccctgtggtga

SEQ ID NO: 8045 - RNA, 9879 nt, synthetic construct
  misc_feature 1..9879: note = derived and/or modified CDS sequence (opt1) from DENV-1__HM181948__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgaggtggagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcgtggaagcagatccagcgggtggagacctgggccctccgccaccccgggttcacggtgatcgccctgttcctggcccacgcgatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgccatcctgcggaagctctgcatcgaggcgaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgccaccatcacgccccaggcgcccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgccaagaagcaggaggtcgtggtgctcggcagccaggagggcgcgatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggccgagacgcagcacggcaccgtgctggtccagatcaagtacgagggcaccgacgcgccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccaccgcccgcggggcccggcgcatggccatcctgggcgacacggcgtgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggccggcatcctcgcgcaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcaccctggccgtgttcctgctcctgatcatggggcagctgacgtggaacgacctcatccgcctgtgcatcatggtcggcgccaacgcgagcgaccgcatggggatgggcaccacctacctggccctcatggccaccttcaagatgcggccgatgttcgccgtggggctgctgttccgccggctcacgtcccgcgaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccttctccctgcactacgcctggaagaccatggccatggtcctcagcatcgtgtccctgttccccctgtgcctcagcacgacctcccagaagaccacctggctgcccgtgctgctcggcagcctggggtgcaagccgctgacgatgttcctcatcgcggagaacaagatctggggccggcgctcctggcccctgaacgaggggatcatggccgtcggcatcgtgagcatcctgctcagctccctgctgaagaacgacgtgcccctcgccgggcccctgatcgccggcggcatgctgatcgcctgctacgtcatcagcgggtccagcgcggacctctccctggagaaggccgccgaggtgagctgggaggaggaggccgagcactccggcgccagccacaacatcctggtggaggtccaggacgacgggaccatgaagatcaaggacgaggagcgggacgacaccctcaccatcctgctgaaggcgaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgccgtcctgatgtaccaggggaagcgcctggagcccagctgggcgtccgtgaagaaggacctcatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgccatcgccctggacttcaagcccgggacgagcggctcccccatcgtgaaccgcgaggggaagatcgtgggcctctacggcaacggggtcgtgaccaccagcggcacctacgtgagcgcgatcgcccaggccaaggcctcccaggaggggccgctgcccgagatcgaggacgaggtcttccggaagcgcaacctgacgatcatggacctccaccccggcagcgggaagacccggcgctacctgccggcgatcgtgcgggaggccatcaagcgcaagctgcgcaccctcatcctggcccccacccgggtggtcgcctccgagatggccgaggcgctgaagggcatgcccatccgctaccagacgaccgccgtcaagagcgagcacaccggcaaggagatcgtggacctcatgtgccacgccaccttcacgatgcggctgctgtcccccgtccgcgtgccgaactacaacatgatcatcatggacgaggcccacttcaccgaccccagctccatcgccgcgcgggggtacatcagcacccgcgtgggcatgggggaggccgccgccatcttcatgaccgccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctccggaagaacgggaagcgcgtgatccagctgtcccggaagaccttcgacacggagtaccagaagaccaagaacaacgactgggactacgtggtcaccaccgacatcagcgagatgggcgccaacttccgcgcggaccgggtgatcgacccgcgccggtgcctgaagcccgtgatcctcaaggacgggcccgagcgcgtcatcctggccggccccatgccggtgacggtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagaccttcgtggagctgatgcgccgcggggacctgcccgtgtggctctcctacaaggtcgccagcgagggcttccagtacagcgaccgccggtggtgcttcgacggcgagcgcaacaaccaggtgctggaggagaacatggacgtggagatctggacgaaggagggggagcggaagaagctgcgcccccggtggctcgacgcccgcacctactccgaccccctggccctgcgggagttcaaggagttcgccgcgggccgccggagcgtctccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacaccatcgagacgctgatgctcctggccctgatcgccgtgctcaccggcggggtcaccctgttcttcctgtccggccgggggctcggcaagaccagcatcggcctgctgtgcgtgatggcctccagcgtgctcctgtggatggcctccgtcgagccccactggatcgcggccagcatcatcctggagttcttcctcatggtgctgctgatccccgagccggaccgccagcggacgccccaggacaaccagctcgcctacgtggtcatcgggctgctgttcatgatcctcacggtggccgccaacgagatgggcctgctggagaccaccaagaaggacctcgggatcggccacgtggcggtcgggaaccaccaccacgccgccatgctggacgtggacctgcaccccgcctccgcctggaccctctacgcggtggccacgaccatcatcaccccgatgatgcgccacaccatcgagaacacgaccgccaacatcagcctgaccgccatcgccaaccaggcggccatcctgatgggcctcgacaagggctggcccatctccaagatggacatcggggtccccctgctggccctcggctgctacagccaggtgaaccccctgaccctgacggccgcggtgctcatgctggtcgcccactacgccatcatcgggccgggcctgcaggccaaggccacccgcgaggcgcagaagcggaccgccgccgggatcatgaagaaccccaccgtggacggcatcgtggccatcgacctcgaccccgtcgtgtacgacgccaagttcgagaagcagctgggccagatcatgctgctcatcctgtgcacgtcccagatcctgctcatgcgcaccacctgggcgctgtgcgagagcatcaccctggccacggggcccctcaccaccctgtgggagggctccccggggaagttctggaacaccacgatcgccgtgagcatggccaacatcttccggggctcctacctggccggcgcggggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtcgaccgcagcgaggccaaggaggggctcaagcggggcgagacgaccaagcacgcggtgtcccgcgggaccgccaagctgcggtggttcgtggagcgcaacctggtcaagcccgagggcaaggtgatcgacctgggctgcgggcggggcgggtggagctactactgcgccggcctcaagaaggtgaccgaggtcaaggggtacacgaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgaccatcgaggaggggcgcacgctgcgggtcctcaagatggtggagccctggctgcgcggcaaccagttctgcatcaagatcctgaacccctacatgcccagcgtggtcgagaccctcgagcagatgcagcggaagcacggcgggatgctggtgcgcaacccgctgtcccggaacagcacccacgagatgtactgggtgtcctgcggcaccgggaacatcgtcagcgccgtgaacatgacctcccgcatgctcctgaaccgcttcacgatggcgcaccggaagcccacctacgagcgcgacgtggacctgggcgccggcacccggcacgtcgccgtggagcccgaggtggccaacctcgacatcatcgggcagcgcatcgagaacatcaagcacgagcacaagagcacctggcactacgacgaggacaacccctacaagacgtgggcctaccacggctcctacgaggtcaagccgagcgggtccgcgagcagcatggtgaacggcgtcgtgaagctgctgaccaagccctgggacgtgatccccatggtcacccagatcgccatgaccgacacgacccccttcgggcagcagcgggtgttcaaggagaaggtggacacccgcaccccgaaggccaagcggggcacggcccagatcatggaggtcaccgccaagtggctctggggcttcctgtcccgcaacaagaagccccggatctgcacccgcgaggagttcacccggaaggtgcgcagcaacgcggccatcggggccgtgttcgtcgacgagaaccagtggaactccgccaaggaggcggtggaggacgagcggttctgggacctggtgcaccgcgagcgggagctccacaagcagggcaagtgcgccacgtgcgtctacaacatgatggggaagcgcgagaagaagctgggcgagttcgggaaggccaagggcagccgggccatctggtacatgtggctgggcgcccgcttcctcgagttcgaggcgctggggttcatgaacgaggaccactggttctcccgggagaacagcctgtccggcgtggagggggagggcctccacaagctggggtacatcctgcgcgacatcagcaagatccccggcggcaacatgtacgccgacgacaccgccgggtgggacacccggatcaccgaggacgacctccagaacgaggcccgcatcacggacatcatggagccggagcacgccctgctggcgaagtccatcttcaagctcacctaccagaacaaggtggtccgcgtgcagcggcccgccaagaacggcaccgtgatggacgtcatcagccgccgggaccagcgcgggtccggccaggtgggcacctacgggctgaacacgttcaccaacatggaggcccagctgatccggcagatggagagcgagggcatcttctcccccagcgagctcgagacccccaacctggccgagcgcgtgctggactggctcgagaagtacggggtcgagcggctgaagcgcatggccatctccggcgacgactgcgtggtgaagccgatcgacgaccggttcgcgaccgccctgacggccctcaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctggtggggcgggcccgcgtgagccagggcgccgggtggagcctccgggagaccgcgtgcctgggcaagtcctacgcccagatgtggcagctgatgtacttccaccgccgggacctccgcctggccgccaacgcgatctgcagcgccgtccccgtggactggatccccacctcccggaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctcggcaagcgcgaggaccagtggtgcggcagcctgatcgggctgacggcccgggccacctgggcgaccaacatccaggtggccatcaaccaggtccgccggctcatcggcaacgagaactacctggactacatgacctccatgaagcgcttcaagaacgagagcgaccccgagggggccctgtggtga

SEQ ID NO: 8046 - RNA, 9879 nt, synthetic construct
  misc_feature 1..9879: note = derived and/or modified CDS sequence (opt1) from DENV-1__HM181949__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacgggccacgggaccaccgcgaccatcacgccccaggcccccacgaccgagatccagctcaccgactacggcgccctgaccctggactgcagcccccgcacggggctcgacttcaacgagatggtgctgctgaccatgaaggagaagtcctggctcgtccacaagcagtggttcctggacctgcccctcccctggaccagcggcgccagcacctcccaggagacgtggaaccggcaggacctgctggtgaccttcaagaccgcccacgcgaagaagcaggaggtggtcgtgctcggcagccaggagggggccatgcacaccgccctgacgggcgccaccgagatccagacctccgggaccacgaccatcttcgccggccacctgaagtgccgcctcaagatggacaagctgaccctgaaggggatgagctacgtgatgtgcaccggctccttcaagctcgagaaggaggtcgcggagacgcagcacggcaccgtgctggtgcagatcaagtacgaggggaccgacgccccctgcaagatccccttcagcacccaggacgagaagggcgtcacgcagaacgggcggctgatcaccgccaacccgatcgtgaccgacaaggagaagcccgtgaacatcgaggccgagccgcccttcggcgagtcctacatcgtcatcggcgcgggggagaaggccctgaagctcagctggttcaagaagggctccagcatcgggaagatgttcgaggccaccgcccgcggcgcccggcgcatggcgatcctgggggacacggcctgggacttcggctccatcggcggggtgttcaccagcgtgggcaagctggtccaccagatcttcgggaccgcctacggcgtcctcttctccggggtgagctggaccatgaagatcggcatcggcgtcctgctgacgtggctcgggctgaactcccgcagcacctccctgagcatgacctgcatcgccgtgggcctcgtgaccctgtacctgggggtcatggtgcaggccgactccggctgcgtgatcaactggaaggggcgggagctcaagtgcggcagcggcatcttcgtcacgaacgaggtgcacacctggaccgagcagtacaagttccaggcggacagcccgaagcgcctgtccgccgccatcgggaaggcctgggaggagggcgtgtgcgggatccggagcgccacccgcctggagaacatcatgtggaagcagatctccaacgagctcaaccacatcctgctggagaacgacatgaagttcaccgtcgtggtgggcgacgtcgcggggatcctcgcccagggcaagaagatgatccggccccagcccatggagtacaagtacagctggaagtcctggggcaaggccaagatcatcggggccgacgtgcagaacacgaccttcatcatcgacggccccaacaccccggagtgccccgacgaccagcgcgcgtggaacatctgggaggtggaggactacgggttcggcatcttcaccacgaacatctggctgaagctgcgggacagctacacccaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctgtggagcaacggggtcctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtggtcgacgagcactgcgggaaccggggcccgtccctgcgcaccaccaccgtgacggggaagatcatccacgagtggtgctgccggagctgcaccctgccgcccctccgcttccggggcgaggacgggtgctggtacggcatggagatccgccccgtgaaggagaaggaggagaacctggtcaagtccatggtgagcgccggcagcggggaggtggactccttcagcctcggcctgctgtgcatctccatcatgatcgaggaggtcatgcggagccgctggtcccggaagatgctcatgaccgggaccctggccgtgttcctgctcctgatcatgggccagctgacgtggaacgacctcatccgcctgtgcatcatggtgggggcgaacgccagcgaccgcatgggcatgggcaccacctacctggccctcatggccaccttcaagatgcggccgatgttcgccgtcgggctgctgttccgccggctcacgtcccgcgaggtgctgctgctcaccatcgggctgagcctggtggcgtccgtcgagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcgggagcctgggctgcaagccgctgacgatgttcctcatcgccgagaacaagatctgggggcggcgctcctggcccctgaacgagggcatcatggccgtggggatcgtcagcatcctgctcagctccctgctgaagaacgacgtgcccctcgccggccccctgatcgccggcgggatgctgatcgcgtgctacgtgatcagcggctccagcgccgacctctccctggagaaggccgccgaggtcagctgggaggaggaggccgagcactccggggcgagccacaacatcctggtggaggtgcaggacgacggcaccatgaagatcaaggacgaggagcgggacgacaccctcaccatcctgctgaaggccaccctcctggccgtctccggggtgtacccgctgagcatccccgccaccctcttcgtgtggtacttctggcagaagaagaagcagcgctccggcgtcctgtgggacacccccagcccgcccgaggtggagcgggccgtgctggacgacggcatctaccgcatcatgcagcgggggctgctcggccgctcccaggtcggggtgggcgtgttccaggagaacgtcttccacaccatgtggcacgtgacccgcggggcggtgctgatgtaccagggcaagcgcctggagcccagctgggcctccgtcaagaaggacctcatcagctacggcgggggctggcggctgcaggggtcctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgagcgggtcccccatcgtcaaccgcgagggcaagatcgtgggcctctacgggaacggcgtggtcaccaccagcgggacctacgtgagcgccatcgcccaggccaaggcgtcccaggagggcccgctgcccgagatcgaggacgaggtgttccggaagcgcaacctgacgatcatggacctccaccccgggagcggcaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccgggaaggagatcgtggacctcatgtgccacgccaccttcacgatgcggctgctgtcccccgtgcgcgtcccgaactacaacatgatcatcatggacgaggcccacttcaccgaccccagctccatcgcggcccggggctacatcagcacccgcgtggggatgggcgaggccgccgccatcttcatgaccgcgacgccgcccgggtccgtggaggccttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctccggaagaacggcaagcgcgtcatccagctgtcccggaagaccttcgacacggagtaccagaagaccaagaacaacgactgggactacgtggtgaccaccgacatcagcgagatgggggcgaacttccgcgccgaccgggtcatcgacccgcgccggtgcctgaagcccgtgatcctcaaggacggccccgagcgcgtgatcctggccgggcccatgccggtcacggtggcctccgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcgatcgacggcgagtaccggctccgcggggaggcccggaagaccttcgtcgagctgatgcgccggggcgacctgcccgtgtggctctcctacaaggtggccagcgagggcttccagtacagcgaccgccggtggtgcttcgacggggagcgcaacaaccaggtcctggaggagaacatggacgtggagatctggacgaaggagggcgagcggaagaagctgcgcccccggtggctcgacgcccgcacctactccgaccccctggccctgcgggagttcaaggagttcgcggccgggcgccggagcgtgtccggcgacctcatcctggagatcggcaagctgccgcagcacctcacccagcgcgcccagaacgccctggacaacctggtcatgctccacaacagcgagcagggcgggcgggcgtaccgccacgccatggaggagctgcccgacaccatcgagacgctgatgctcctggccctgatcgccgtgctcaccgggggcgtgaccctgttcttcctgtccgggcggggcctcggcaagaccagcatcgggctgctgtgcgtcatggcctccagcgtgctcctgtggatggcgtccgtggagccccactggatcgccgccagcatcatcctggagttcttcctcatggtcctgctgatccccgagccggaccgccagcggacgccccaggacaaccagctcgcctacgtggtgatcggcctgctgttcatgatcctcacggtcgccgcgaacgagatggggctgctggagaccaccaagaaggacctcggcatcgggcacgtggccgtgggcaaccaccaccacgccgccatgctggacgtcgacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaaggggtggcccatctccaagatggacatcggcgtgcccctgctggccctcgggtgctacagccaggtcaaccccctgaccctgacggcggccgtgctcatgctggtggcccactacgccatcatcggcccggggctgcaggccaaggcgacccgcgaggcccagaagcggaccgccgccggcatcatgaagaaccccaccgtcgacggcatcgtggccatcgacctcgaccccgtggtctacgacgcgaagttcgagaagcagctggggcagatcatgctgctcatcctgtgcacgtcccagatcctgctcatgcgcaccacctgggccctgtgcgagagcatcaccctggccacgggccccctcaccaccctgtgggaggggtccccgggcaagttctggaacaccacgatcgccgtgagcatggccaacatcttccggggctcctacctggcgggggccggcctcgccttcagcctgatgaagtccctggggcgcggccggcgcgggaccggcgcccagggcgagaccctcggggagaagtggaagcggcagctgaaccagctgtccaagagcgagttcaacacctacaagcgctccggcatcatggaggtggaccggagcgaggcgaaggaggggctcaagcgcggcgagacgaccaagcacgccgtctcccgggggaccgccaagctgcgctggttcgtggagcggaacctggtgaagcccgagggcaaggtcatcgacctgggctgcgggcgcggcgggtggagctactactgcgccggcctcaagaaggtgaccgaggtgaaggggtacacgaagggcggccccgggcacgaggagcccatcccgatggccacctacggctggaacctggtcaagctgcactccgggaaggacgtgttcttcatcccgcccgagaagtgcgacaccctcctgtgcgacatcggcgagagctcccccaacccgaccatcgaggaggggcggacgctgcgcgtgctcaagatggtcgagccctggctgcggggcaaccagttctgcatcaagatcctgaacccctacatgcccagcgtggtggagaccctcgagcagatgcagcgcaagcacggcgggatgctggtccggaacccgctgtcccgcaacagcacccacgagatgtactgggtgtcctgcggcaccgggaacatcgtgagcgcggtcaacatgacctcccgcatgctcctgaaccggttcacgatggcccaccgcaagcccacctacgagcgggacgtggacctgggcgccggcacccgccacgtggccgtcgagcccgaggtggccaacctcgacatcatcgggcagcggatcgagaacatcaagcacgagcacaagagcacctggcactacgacgaggacaacccctacaagacgtgggcgtaccacggctcctacgaggtgaagccgagcgggtccgccagcagcatggtcaacggcgtggtcaagctgctgaccaagccctgggacgtgatccccatggtgacccagatcgccatgaccgacacgacccccttcgggcagcagcgcgtcttcaaggagaaggtggacacccggaccccgaaggccaagcgcggcacggcccagatcatggaggtgaccgcgaagtggctctggggcttcctgtcccggaacaagaagccccgcatctgcacccgggaggagttcacccgcaaggtccggagcaacgccgccatcggggccgtgttcgtggacgagaaccagtggaactccgcgaaggaggccgtcgaggacgagcgcttctgggacctggtgcaccgggagcgcgagctccacaagcagggcaagtgcgccacgtgcgtgtacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgccgacgacaccgccgggtgggacacccgcatcaccgaggacgacctccagaacgaggcccgcatcacggacatcatggagccggagcacgcgctgctggccaagtccatcttcaagctcacctaccagaacaaggtggtgcgggtccagcgccccgccaagaacggcaccgtgatggacgtgatcagccggcgcgaccagcgggggtccggccaggtcggcacctacgggctgaacacgttcaccaacatggaggcccagctgatccgccagatggagagcgagggcatcttctcccccagcgagctcgagacccccaacctggccgagcgggtgctggactggctcgagaagtacggggtggagcgcctgaagcggatggcgatctccggcgacgactgcgtcgtgaagccgatcgacgaccgcttcgccaccgccctgacggccctcaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctggtcgggcgcgcccgggtgagccagggcgcggggtggagcctccgcgagaccgcctgcctgggcaagtcctacgcccagatgtggcagctgatgtacttccaccggcgcgacctccggctggccgcgaacgccatctgcagcgccgtgcccgtcgactggatccccacctcccgcaccacgtggagcatccacgcccaccaccagtggatgaccaccgaggacatgctgtccgtgtggaaccgcgtgtggatcgaggagaacccctggatggaggacaagacccacatcagctcctggggcgacgtcccgtacctcggcaagcgggaggaccagtggtgcggcagcctgatcgggctgacggcccgcgcgacctgggccaccaacatccaggtggccatcaaccaggtgcggcgcctcatcggcaacgagaactacctggactacatgacctccatgaagcggttcaagaacgagagcgaccccgagggggccctgtggtga

SEQ ID NO: 8047 - RNA, 9879 nt, synthetic construct
  misc_feature 1..9879: note = derived and/or modified CDS sequence (opt1) from DENV-1__HM181950__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcgccgcctacggggtcctcttctccggcgtgagctggaccatgaagatcgggatcggcgtcctgctgacctggctcggcctgaactcccgcagcacgtccctgagcatgacctgcatcgccgtggggctcgtgaccctgtacctgggcgtcatggtgcaggcggactccgggtgcgtgatcaactggaagggccgggagctcaagtgcgggagcggcatcttcgtcaccaacgaggtgcacacgtggaccgagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagttcaccgtcgtggtgggggacgtcgccggcatcctcgcccaggggaagaagatgatccggccccagcccatggagtacaagtacagctggaagtcctggggcaaggccaagatcatcggcgcggacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggtctgcgaccaccgcctcatgtccgccgccatcaaggacagcaaggccgtgcacgcggacatgggctactggatcgagtccgagaagaacgagacctggaagctggcccgggccagcttcatcgaggtgaagacctgcatctggcccaagtcccacaccctgtggagcaacggcgtcctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggcggtgttcctgctcctgatcatggggcagctgacctggaacgacctcatccgcctgtgcatcatggtgggcgccaacgccagcgaccgcatggggatgggcacgacctacctggccctcatggccaccttcaagatgcggccgatgttcgcggtcgggctgctgttccgccggctcacctcccgcgaggtgctgctgctcacgatcgggctgagcctggtggcctccgtcgagctccccaacagcctggaggagctgggcgacgggctcgccatgggcatcatgatcctgaagctgctcaccgacttccagtcccaccagctgtgggccaccctgctcagcctgaccttcatcaagacgaccttctccctgcactacgcgtggaagaccatggccatggtgctcagcatcgtctccctgttccccctgtgcctcagcaccacgtcccagaagaccacctggctgcccgtgctgctcggcagcctggggtgcaagccgctgaccatgttcctcatcgccgagaacaagatctggggccggcgctcctggcccctgaacgaggggatcatggccgtgggcatcgtcagcatcctgctcagctccctgctgaagaacgacgtgcccctcgccgggcccctgatcgcgggcggcatgctgatcgcctgctacgtgatcagcgggtccagcgccgacctctccctggagaaggccgccgaggtcagctgggaggaggaggcggagcactccggcgccagccacaacatcctggtggaggtgcaggacgacgggacgatgaagatcaaggacgaggagcgggacgacaccctcaccatcctgctgaaggccaccctcctggccgtctccggcgtgtacccgctgagcatccccgccaccctcttcgtgtggtacttctggcagaagaagaagcagcgctccggggtcctgtgggacacgcccagcccgcccgaggtggagcgggcggtgctggacgacggcatctaccgcatcatgcagcggggcctgctcgggcgctcccaggtcggcgtgggggtgttccaggagaacgtcttccacaccatgtggcacgtgacccggggcgccgtgctgatgtaccaggggaagcgcctggagcccagctgggcctccgtcaagaaggacctcatcagctacggcggcgggtggcggctgcagggctcctggaacaccggggaggaggtccaggtgatcgccgtcgagcccggcaagaaccccaagaacgtgcagacggcccccgggaccttcaagacccccgagggcgaggtgggcgcgatcgccctggacttcaagcccgggaccagcggctcccccatcgtcaaccgcgaggggaagatcgtgggcctctacggcaacggggtggtcacgaccagcggcacctacgtgagcgccatcgcccaggcgaaggcctcccaggaggggccgctgcccgagatcgaggacgaggtgttccggaagcgcaacctgaccatcatggacctccaccccggcagcgggaagacgcggcgctacctgccggccatcgtccgggaggccatcaagcgcaagctgcgcaccctcatcctggcccccacccgggtggtggcgtccgagatggccgaggccctgaagggcatgcccatccgctaccagaccacggccgtcaagagcgagcacaccggcaaggagatcgtggacctcatgtgccacgccaccttcaccatgcggctgctgtcccccgtgcgcgtcccgaactacaacatgatcatcatggacgaggcgcacttcacggaccccagctccatcgccgcccgggggtacatcagcacccgcgtgggcatgggggaggccgccgcgatcttcatgaccgccacgccgcccggctccgtggaggccttcccgcagagcaacgccgtcatccaggacgaggagcgggacatccccgagcgctcctggaacagcgggtacgagtggatcacggacttccccggcaagaccgtgtggttcgtgccctccatcaagagcggcaacgacatcgcgaactgcctccggaagaacgggaagcgcgtcatccagctgtcccggaagaccttcgacaccgagtaccagaagacgaagaacaacgactgggactacgtggtgaccaccgacatcagcgagatgggcgccaacttccgcgccgaccgggtcatcgacccgcgccggtgcctgaagcccgtgatcctcaaggacgggcccgagcgcgtgatcctggccggccccatgccggtcaccgtggcctccgcggcccagcggcgcgggcggatcggccgcaaccacaacaaggagggcgaccagtacatctacatggggcagcccctgaacaacgacgaggaccacgcccactggacggaggccaagatgctcctggacaacatcaacacccccgagggcatcatccccgccctgttcgagccggagcgcgagaagtccgcggccatcgacggggagtaccggctccgcggcgaggcccggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacgtactccgaccccctggcgctgcgggagttcaaggagttcgccgccggccgccggagcgtgtccggggacctcatcctggagatcggcaagctgccgcagcacctcacccagcgcgcccagaacgcgctggacaacctggtcatgctccacaacagcgagcagggcgggcgggcctaccgccacgccatggaggagctgcccgacaccatcgagaccctgatgctcctggccctgatcgccgtgctcacgggcggggtgaccctgttcttcctgtccggccgggggctcggcaagaccagcatcggcctgctgtgcgtcatggcgtccagcgtgctcctgtggatggcctccgtggagccccactggatcgccgccagcatcatcctggagttcttcctcatggtcctgctgatccccgagccggaccgccagcggacgccccaggacaaccagctcgcctacgtggtgatcgggctgctgttcatgatcctcaccgtcgcggccaacgagatgggcctgctggagacgaccaagaaggacctcgggatcggccacgtggccgtggggaaccaccaccacgccgccatgctggacgtcgacctgcaccccgcgtccgcctggaccctctacgccgtggccaccacgatcatcaccccgatgatgcgccacaccatcgagaacaccacggccaacatcagcctgaccgcgatcgccaaccaggccgccatcctgatgggcctcgacaagggctggcccatctccaagatggacatcggggtgcccctgctggcgctcggctgctacagccaggtcaaccccctgaccctgaccgccgccgtgctcatgctggtggcccactacgccatcatcgggccgggcctgcaggcgaaggccacgcgcgaggcccagaagcggaccgccgccgggatcatgaagaaccccaccgtcgacggcatcgtggcgatcgacctcgaccccgtggtctacgacgccaagttcgagaagcagctgggccagatcatgctgctcatcctgtgcacctcccagatcctgctcatgcgcacgacctgggccctgtgcgagagcatcaccctggccaccgggcccctcacgaccctgtgggagggctccccggggaagttctggaacaccaccatcgccgtgagcatggcgaacatcttccggggctcctacctggccggcgccgggctcgccttcagcctgatgaagtccctgggcgggggccgccgggggacgggcgcgcagggcgagaccctcggggagaagtggaagcgccagctgaaccagctgtccaagagcgagttcaacacctacaagcggtccggcatcatggaggtggaccgcagcgaggccaaggaggggctcaagcggggcgagaccacgaagcacgccgtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacaccaagggcggccccgggcacgaggagcccatcccgatggcgacgtacggctggaacctggtcaagctgcactccgggaaggacgtgttcttcatcccgcccgagaagtgcgacaccctcctgtgcgacatcggcgagagctcccccaacccgaccatcgaggaggggcgcaccctgcgggtgctcaagatggtcgagccctggctgcgcggcaaccagttctgcatcaagatcctgaacccctacatgcccagcgtggtggagacgctcgagcagatgcagcggaagcacggcgggatgctggtccgcaacccgctgtcccggaacagcacccacgagatgtactgggtgtcctgcggcaccgggaacatcgtgagcgccgtcaacatgacctcccgcatgctcctgaaccgcttcaccatggcccaccggaagcccacgtacgagcgcgacgtggacctgggcgccggcacccggcacgtggccgtcgagcccgaggtggcgaacctcgacatcatcgggcagcgcatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctgctgacgaagccctgggacgtgatccccatggtgacccagatcgccatgaccgacaccacgcccttcgggcagcagcgggtcttcaaggagaaggtggacacccgcaccccgaaggccaagcggggcaccgcgcagatcatggaggtgacggccaagtggctctggggcttcctgtcccgcaacaagaagccccggatctgcacccgcgaggagttcacccggaaggtccgcagcaacgccgccatcggggcggtgttcgtggacgagaaccagtggaactccgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggcgatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgccgacgacacggccgggtgggacacccggatcaccgaggacgacctccagaacgaggcgcgcatcaccgacatcatggagccggagcacgccctgctggccaagtccatcttcaagctcacgtaccagaacaaggtggtgcgcgtccagcggcccgccaagaacggcaccgtgatggacgtgatcagccgccgggaccagcgcgggtccggccaggtcggcacctacagcctgaacaccttcacgaacatggaggcccagctgatccggcagatggagtccgaggggatcttcagcccctccgagctcgagacccccaacctggcggagcgcgtgctggactggctcgagaagtacggcgtggagcggctgaagcgcatggccatcagcggggacgactgcgtcgtgaagccgatcgacgaccggttcgccaccgccctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtggtgccgtgccgcaaccaggacgagctggtcggccgggcgcgcgtgagccagggggccggctggtccctccgggagacggcctgcctgggcaagagctacgcccagatgtggcagctgatgtacttccaccgccgggacctccgcctggcggccaacgccatctgctccgccgtgcccgtcgactggatccccaccagccggaccacctggtccatccacgcccaccaccagtggatgacgaccgaggacatgctgagcgtgtggaaccgcgtgtggatcgaggagaacccctggatggaggacaagacccacatctccagctggggcgacgtcccgtacctcgggaagcgcgaggaccagtggtgcggctccctgatcggcctgaccgcgcgggccacgtgggccaccaacatccaggtggccatcaaccaggtgcgccggctcatcgggaacgagaactacctggactacatgaccagcatgaagcgcttcaagaacgagtccgaccccgagggcgccctgtggtga

SEQ ID NO: 8048 - RNA, 9879 nt, synthetic construct
  misc_feature 1..9879: note = derived and/or modified CDS sequence (opt1) from DENV-1__HM181952__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtcacctacgggacctgcagccagaccggcgagcaccggcgcgagaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggtgcaggggaagaagatgatccggccccagcccatggagtacaagtacagctggaagtcctggggcaaggccaagatcatcggcgccgacgtccagaacagcacgttcatcatcgacgggcccaacaccccggagtgccccgacgaccagcgcgcctggaacatctgggaggtggaggactacggcttcgggatcttcaccaccaacatctggctgaagctccgggactcctacacccaggtgtgcgaccaccgcctgatgagcgcggccatcaaggactccaaggccgtccacgccgacatgggctactggatcgagagcgagaagaacgagacctggaagctggccaaggcgtccttcatcgaggtgaagacctgcatctggcccaagagccacaccctctggtccaacggcgtgctggagagcgagatgatcatccccaagatccacgggggcccgatctcccagcacaactaccggcccgggtacttcacgcagaccgccggcccctggcacctggggaagctcgagctggacttcgacctgtgcgagggcaccaccgtcgtggtggacgagcactgcggcaaccgcgggccgagcctccggacgaccaccgtcaccggcaagatcatccacgagtggtgctgccgctcctgcacgctgccgcccctgcggttccgcggggaggacggctgctggtacgggatggagatccggcccgtgaaggagaaggaggagaacctcgtgaagtccatggtcagcgccggctccggcgaggtggacagcttctccctggggctgctctgcatcagcatcatgatcgaggaggtgatgcgctcccggtggagccgcaagatgctgatgaccggcaccctggccgtcttcttcctcctgatcatggggcagctgacctggaacgacctcatccggctgtgcatcatggtgggcgccaacgcgtccgaccgcatggggatgggcacgacctacctggccctcatggccaccttcaagatgcgcccgatgttcgccgtggggctgctgttccggcgcctcaccagccgggaggtcctgctgctcacgatcgggctgtccctggtggccagcgtcgagctccccaactccctggaggagctgggcgacgggctcgcgatgggcatcatgatcctgaagctgctcaccgacttccagagctaccagctgtgggccaccctgctctccctgaccttcatcaagacgaccttcagcctgcactacgcctggaagaccatggccatggtgctctccatcgtgagcctgttccccctgtgcctctccaccacgagccagaagaccacctggctgcccgtcctgctcggctccctggggtgcaagccgctgaccatgttcctcatcgcggagaacaagatctggggccgcaagagctggcccctgaacgaggggatcatggccgtgggcatcgtgagcatcctgctctccagcctgctgaagaacgacgtccccctcgccgggcccctgatcgccggcggcatgctgatcgcctgctacgtgatctccgggagctccgcggacctcagcctggagaaggccgccgaggtgtcctgggaggaggaggccgagcacagcggcgcctcccacaacatcctggtcgaggtgcaggacgacgggacgatgaagatcaaggacgaggagcgggacgacaccctcaccatcctgctgaaggcgaccctcctggccgtgagcggcgtctacccgctgtccatccccgccaccctcttcgtgtggcacttctggcagaagaagaagcagcgcagcggggtgctgtgggacacgcccagcccgcccgaggtcgagcgggccgtgctggacgacggcatctaccgcatcatgcagcggggcctgctcgggcgcagccaggtgggcgtcggggtgttccaggagaacgtgttccacaccatgtggcacgtcacccggggcgccgtgctgatgtaccaggggaagcgcctggagccctcctgggcgagcgtgaagaaggacctcatctcctacggcggcgggtggcggctgcagggcagctggaacaccggggaggaggtccaggtgatcgccgtggagcccggcaagaaccccaagaacgtccagacggcccccgggaccttcaagacccccgagggcgaggtgggcgccatcgccctggacttcaagcccgggacctccggcagccccatcgtgaaccgcgaggggaagatcgtcggcctctacggcaacggggtggtgacgaccagcggcacctacgtctccgcgatcgcccaggccaaggccagccaggaggggccgctgcccgagatcgaggacgaggtgttccggaagcgcaacctgaccatcatggacctccaccccggctccgggaagacgcggcgctacctgccggcgatcgtgcgggaggccatcaagcgcaagctgcggaccctcatcctggcccccacccgcgtcgtggccagcgagatggccgaggcgctgaagggcatgcccatccgctaccagaccacggccgtgaagtccgagcacaccggcaaggagatcgtcgacctcatgtgccacgccaccttcaccatgcggctgctgagccccgtgcgcgtgccgaactacaacatgatcatcatggacgaggcccacttcacggacccctccagcatcgccgcgcgggggtacatctccacccgcgtcggcatgggggaggccgccgccatcttcatgaccgccacgccgcccggcagcatggaggcgttcccgcagtccaacgccgtgatccaggacgaggagcgggacatccccgagcgcagctggaactccgggtacgagtggatcacggacttccccggcaagaccgtgtggttcgtccccagcatcaaggccggcaacgacatcgccaactgcctccggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccgcgccggtgcctgaagcccgtgatcctcaaggacgggcccgagcgcgtcatcctggccggccccatgccggtgaccgtcgcctccgccgcgcagcggcgcgggcggatcggccgcaaccacaacaaggagggcgaccagtacatctacatggggcagcccctgaacaacgacgaggaccacgcccactggacggaggccaagatgctcctggacaacatcaacacccccgagggcatcatccccgccctgttcgagccggagcgggagaagtccgccgcgatcgacggggagtaccgcctccgcggcgaggcccggaagaccttcgtggagctgatgcgccgcggggacctgcccgtgtggctctcctacaaggtcgccagcgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacgtactccgaccccctggccctgcgggagttcaaggagttcgcggccggccgccggagcgtctccggggacctcatcctggagatcggcaagctgccgcagcacctcacccagcgcgcccagaacgccctggacaacctggtgatgctccacaacagcgagcagggcgggcgggcgtaccgccacgccatggaggagctgcccgacaccatcgagaccctgatgctcctggccctgatcgccgtgctcacgggcggggtcaccctgttcttcctgtccggcaaggggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagccggaccggcagcgcacgccccaggacaaccagctcgcctacgtggtcatcgggctgctgttcatgatcctcaccgtggccgcgaacgagatgggcctgctggagacgaccaagaaggacctcgggatcggccacgtggccgtcgagaaccaccaccacgccgccatgctggacgtggacctgcaccccgcctccgcgtggaccctctacgccgtggccaccacgatcatcaccccgatgatgcggcacaccatcgagaacaccacggccaacatcagcctgaccgccatcgcgaaccaggccgccatcctgatggggctcgacaagggctggcccatctccaagatggacatcggcgtccccctgctggccctcgggtgctacagccaggtgaaccccctgaccctgaccgcggccgtgctcatgctggtcgcccactacgccatcgtgggcccggggctgcaggccaaggcgacgcgcgaggcccagaagcggaccgccgccggcatcatgaagaaccccaccatcgacgggatcgtggccatcgacctcgaccccgtcgtgtacgacgcgaagttcgagaagcagctgggccagatcatgctgctcatcctgtgcacctcccagatcctgctcatgcgcacgacctgggccctgtgcgagagcatcaccctggccaccggccccctcacgaccctgtgggaggggtccccgggcaagttctggaacaccaccatcgccgtgagcatggccaacatcttccgcgggtcctacctggcgggcgccggcctcgccttcagcctgatgaagtccctcgggggcgggcggcgcgggacgggggcccagggcgagaccctcggcgagaagtggaagcggcagctgaaccagctgtccaagagcgagttcaacacctacaagcgctccgggatcatggaggtcgaccggagcgaggcgaaggagggcctcaagcgcggggagaccacgaagcacgccgtgtcccggggcaccgccaagctgcgctggttcgtggagcggaacctggtcaagcccgaggggaaggtgatcgacctgggctgcggccgcgggggctggagctactactgcgccgggctcaagaaggtgaccgaggtcaagggctacaccaagggcgggcccggccacgaggagcccatcccgatggccacgtacgggtggaacctggtgaagctgcactccggcaaggacgtgttcttcatcccgcccgagaagtgcgacaccctcctgtgcgacatcggggagagctcccccaacccgaccatcgaggagggccggaccctgcgcgtcctcaagatggtggagccctggctgcgggggaaccagttctgcatcaagatcctgaacccctacatgcccagcgtggtcgagacgctcgagcagatgcagcgcaagcacggcggcatgctggtgcggaacccgctgtcccgcaacagcacccacgagatgtactgggtgtcctgcgggaccggcaacatcgtcagcgcggtgaacatgacctcccggatgctcctgaaccgcttcaccatggcccaccggaagcccacgtacgagcgcgacgtggacctgggggccggcacccgccacgtcgccgtggagcccgaggtggccaacctcgacatcatcggccagcggatcgagaacatcaagcacgagcacaagagcacctggcactacgacgaggacaacccctacaagacctgggcgtaccacgggtcctacgaggtcaagccgagcggctccgccagcagcatggtgaacggggtcgtgaagctgctgacgaagccctgggacgtgatccccatggtcacccagatcgccatgaccgacaccacgcccttcggccagcagcgcgtgttcaaggagaaggtggacacccggaccccgaaggccaagcgcgggaccgcccagatcatggaggtcacggcgcggtggctctggggcttcctgtcccgcaacaagaagccccggatctgcacccgcgaggagttcacccggaaggtgcgcagcaacgccgccatcggcgccgtgttcgtcgacgagaaccagtggaactccgcgaaggaggccgtggaggacgaccggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacacggccggctgggacacccggatcaccgaggacgacctccagaacgaggccaagatcaccgacatcatggagccggagcacgcgctgctggccaagtccatcttcaagctcacgtaccagaacaaggtggtccgcgtgcagcggcccgccaagaacgggaccgtgatggacgtcatcagccgccgcgaccagcggggctccggccaggtgggcacctacggcctgaacaccttcacgaacatggaggcccagctgatccgccagatggagagcgaggggatcttcctccccaacgagctggagacccccaacctggccgagcgggtgctcgactggctggagaagtacggcgtcgagcgcctgaagcggatggcgatctccggggacgactgcgtggtgaagccgatcgacgaccgcttcgccaccgccctcaccgccctgaacgacatgggcaaggtccggaaggacatcccccagtgggagcccagcaaggggtggaacgactggcagcaggtccccttctgctcccaccacttccaccagctgatcatgaaggacggccgcgagatcgtggtcccgtgccggaaccaggacgagctcgtgggccgcgcccgggtgagccagggggcgggctggtccctgcgcgagacggcctgcctgggcaagagctacgcccagatgtggcagctcatgtacttccaccggcgcgacctgcggctggccgcgaacgccatctgcagcgccgtccccgtggactgggtgcccacctcccgcaccacctggagcatccacgcccaccaccagtggatgacgaccgaggacatgctctccgtctggaaccgggtgtggatcgaggagaacccctggatggaggacaagacccgcatcagctcctgggaggacgtgccgtacctgggcaagcgggaggaccagtggtgcgggagcctgatcggcctcaccgcccgcgcgacgtgggccaccaacatccaggtcgccatcaaccaggtgcgccggctgatcggcaacgagaactactccgactacatgaccagcatgaagcgcttcaagaacgagtccgagcccgagggggccctgtggtga

SEQ ID NO: 8049 - RNA, 9879 nt, synthetic construct
  misc_feature 1..9879: note = derived and/or modified CDS sequence (opt1) from DENV-1__HM181953__SS-prME
  source 1..9879: mol_type = other RNA
agcgtgaccatgctgctcatgctgatgcccaccgcgctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgcgggcatcctcgtgcaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcaccctggccgtgttcctgctcctgatcatggggcagctgacgtggaacgacctcatccgcctgtgcatcatggtcggcgccaacgcgagcgaccgcatggggatgggcaccacctacctggccctcatggccaccttcaagatgcggccgatgttcgccgtggggctgctgttccgccggctcacgtcccgcgaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccttctccctgcactacgcctggaagaccatggccatggtcctcagcatcgtgtccctgttccccctgtgcctcagcacgacctcccagaagaccacctggctgcccgtgctgctcggcagcctggggtgcaagccgctgacgatgttcctcatcgcggagaacaagatctggggccggcgctcctggcccctgaacgaggggatcatggccgtcggcatcgtgagcatcctgctcagctccctgctgaagaacgacgtgcccctcgccgggcccctgatcgccggcggcatgctgatcgcctgctacgtcatcagcgggtccagcgcggacctctccctggagaaggccgccgaggtgagctgggaggaggaggccgagcactccggcgccagccacaacatcctggtggaggtccaggacgacgggaccatgaagatcaaggacgaggagcgggacgacaccctcaccatcctgctgaaggcgaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgccgtcctgatgtaccaggggaagcgcctggagcccagctgggcgtccgtgaagaaggacctcatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgccatcgccctggacttcaagcccgggacgagcggctcccccatcgtgaaccgcgaggggaagatcgtgggcctctacggcaacggggtcgtgaccaccagcggcacctacgtgagcgcgatcgcccaggccaaggcctcccaggaggggccgctgcccgagatcgaggacgaggtcttccggaagcgcaacctgacgatcatggacctccaccccggcagcgggaagacccggcgctacctgccggcgatcgtgcgggaggccatcaagcgcaagctgcgcaccctcatcctggcccccacccgggtggtcgcctccgagatggccgaggcgctgaagggcatgcccatccgctaccagacgaccgccgtcaagagcgagcacaccggcaaggagatcgtggacctcatgtgccacgccaccttcacgatgcggctgctgtcccccgtccgcgtgccgaactacaacatgatcatcatggacgaggcccacttcaccgaccccagctccatcgccgcgcgggggtacatcagcacccgcgtgggcatgggggaggccgccgccatcttcatgaccgccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctccggaagaacgggaagcgcgtgatccagctgtcccggaagaccttcgacacggagtaccagaagaccaagaacaacgactgggactacgtggtcaccaccgacatcagcgagatgggcgccaacttccgcgcggaccgggtgatcgacccgcgccggtgcctgaagcccgtgatcctcaaggacgggcccgagcgcgtcatcctggccggccccatgccggtgacggtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagaccttcgtggagctgatgcgccgcggggacctgcccgtgtggctctcctacaaggtcgccagcgagggcttccagtacagcgaccgccggtggtgcttcgacggcgagcgcaacaaccaggtgctggaggagaacatggacgtggagatctggacgaaggagggggagcggaagaagctgcgcccccggtggctcgacgcccgcacctactccgaccccctggccctgcgggagttcaaggagttcgccgcgggccgccggagcgtctccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacaccatcgagacgctgatgctcctggccctgatcgccgtgctcaccggcggggtcaccctgttcttcctgtccggccgggggctcggcaagaccagcatcggcctgctgtgcgtgatggcctccagcgtgctcctgtggatggcctccgtcgagccccactggatcgcggccagcatcatcctggagttcttcctcatggtgctgctgatccccgagccggaccgccagcggacgccccaggacaaccagctcgcctacgtggtcatcgggctgctgttcatgatcctcacggtggccgccaacgagatgggcctgctggagaccaccaagaaggacctcgggatcggccacgtggcggtcgggaaccaccaccacgccgccatgctggacgtggacctgcaccccgcctccgcctggaccctctacgcggtggccacgaccatcatcaccccgatgatgcgccacaccatcgagaacacgaccgccaacatcagcctgaccgccatcgccaaccaggcggccatcctgatgggcctcgacaagggctggcccatctccaagatggacatcggggtccccctgctggccctcggctgctacagccaggtgaaccccctgaccctgacggccgcggtgctcatgctggtcgcccactacgccatcatcgggccgggcctgcaggccaaggccacccgcgaggcgcagaagcggaccgccgccgggatcatgaagaaccccaccgtggacggcatcgtggccatcgacctcgaccccgtcgtgtacgacgccaagttcgagaagcagctgggccagatcatgctgctcatcctgtgcacgtcccagatcctgctcatgcgcaccacctgggcgctgtgcgagagcatcaccctggccacggggcccctcaccaccctgtgggagggctccccggggaagttctggaacaccacgatcgccgtgagcatggccaacatcttccggggctcctacctggccggcgcggggctcgccttcagcctgatgaagtccctgggcgggggccgccgggggaccggcgcccagggcgagaccctcggggagaagtggaagcgccagctgaaccagctgtccaagctcgagttcaacacctacaagcggagcggcatcatggaggtcgaccgctccgaggccaaggaggggctgaagcggggcgagacgaccaagcacgcggtgagccgcgggaccgccaagctgcggtggttcgtggagcgcaacctggtcaagcccgagggcaaggtgatcgacctcggctgcgggcggggcgggtggtcctactactgcgccggcctgaagaaggtgaccgaggtcaaggggtacacgaagggcggccccgggcacgaggagcccatcccgatggccacctacggctggaacctggtgaagctccacagcgggaaggacgtgttcttcatcccgcccgagaagtgcgacaccctgctgtgcgacatcggcgagtccagccccaacccgaccatcgaggaggggcgcacgctccgggtcctgaagatggtggagccctggctgcgcggcaaccagttctgcatcaagatcctcaacccctacatgccctccgtggtcgagaccctggagcagatgcagcggaagcacggcgggatgctggtgcgcaacccgctcagccggaactccacccacgagatgtactgggtgagctgcggcaccgggaacatcgtctccgccgtgaacatgaccagccgcatgctgctgaaccgcttcacgatggcgcaccggaagcccacctacgagcgcgacgtggacctcggcgccggcacccggcacgtcgccgtggagcccgaggtggccaacctggacatcatcgggcagcgcatcgagaacatcaagcacgagcacaagtccacctggcactacgacgaggacaacccctacaagacgtgggcctaccacggcagctacgaggtcaagccgtccgggagcgcgtccagcatggtgaacggcgtcgtgaagctgctcaccaagccctgggacgtgatccccatggtcacccagatcgccatgaccgacacgacccccttcgggcagcagcgggtgttcaaggagaaggtggacacccgcaccccgaaggccaagcggggcacggcccagatcatggaggtcaccgccaagtggctgtggggcttcctgagccgcaacaagaagccccggatctgcacccgcgaggagttcacccggaaggtgcgctccaacgcggccatcggggccgtgttcgtcgacgagaaccagtggaacagcgccaaggaggcggtggaggacgagcggttctgggacctcgtgcaccgcgagcgggagctgcacaagcagggcaagtgcgccacgtgcgtctacaacatgatggggaagcgcgagaagaagctgggcgagttcgggaaggccaagggctcccgggccatctggtacatgtggctcggcgcccgcttcctggagttcgaggcgctggggttcatgaacgaggaccactggttcagccgggagaactccctcagcggcgtggagggggagggcctgcacaagctggggtacatcctccgcgacatctccaagatccccggcggcaacatgtacgccgacgacaccgccgggtgggacacccggatcaccgaggacgacctgcagaacgaggcccgcatcacggacatcatggagccggagcacgccctgctcgccaagagcatcttcaagctgacctaccagaacaaggtggtccgcgtgcagcggcccgccaagaacggcaccgtgatggacgtcatctcccgccgggaccagcgcgggagcggccaggtgggcacctacgggctgaacacgttcaccaacatggaggcccagctcatccggcagatggagtccgagggcatcttcagcccctccgagctggagacccccaacctggccgagcgcgtgctcgactggctggagaagtacggggtcgagcggctgaagcgcatggccatcagcggcgacgactgcgtggtgaagccgatcgacgaccggttcgcgaccgccctcacggccctgaacgacatggggaaggtccgcaaggacatcccccagtgggagccctccaagggctggaacgactggcagcaggtccccttctgcagccaccacttccaccagctgatcatgaaggacggccgggagatcgtggtcccgtgccgcaaccaggacgagctcgtggggcgggcccgcgtgtcccagggcgccgggtggagcctgcgggagaccgcgtgcctgggcaagagctacgcccagatgtggcagctcatgtacttccaccgccgggacctgcgcctggccgccaacgcgatctgctccgccgtccccgtggactggatccccaccagccggaccacgtggtccatccacgcccaccaccagtggatgaccaccgaggacatgctcagcgtgtggaaccgcgtctggatcgaggagaacccctggatggaggacaagacccacatctccagctggggcgacgtgccgtacctgggcaagcgcgaggaccagtggtgcggctccctgatcgggctcacggcccgggccacctgggcgaccaacatccaggtggccatcaaccaggtccgccggctgatcggcaacgagaactacctggactacatgaccagcatgaagcgcttcaagaacgagtccgaccccgagggggccctctggtga

SEQ ID NO: 8050 - RNA, 9879 nt, synthetic construct
  misc_feature 1..9879: note = derived and/or modified CDS sequence (opt1) from DENV-1__KF921933__SS-prME
  source 1..9879: mol_type = other RNA
agcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagcaagtgcccgacccagggcgaggccaccctggtggaggagcaggacgccaacttcgtgtgccgccggaccttcgtcgaccgcggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcaccccccaggcccccacgaccgagatccagctcaccgactacggggccctgaccctggactgcagcccccggacgggcctcgacttcaacgagatggtgctgctgaccatgaaggagaagtcctggctcgtccacaagcagtggttcctggacctgccgctcccctggaccagcggggccagcacctcccaggagacgtggaaccgccaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccggctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccgcctgatcaccgccaacccgatcgtgaccgacaaggagaagcccgtgaacatcgaggccgagccccccttcggggagtcctacatcgtcatcggcgcgggcgagaaggccctgaagctcagctggttcaagaaggggtccagcatcggcaagatgttcgaggccaccgcccggggggcccgccggatggcgatcctgggcgacacggcctgggacttcgggtccatcggcggcgtgttcaccagcgtggggaagctggtccaccagatcttcggcaccgcctacggggtgctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgcgagctcaagtgcgggagcggcatcttcgtcacgaacgaggtgcacacctggaccgagcagtacaagttccaggcggacagcccgaagcggctgtccgccgccatcggcaaggcctgggaggagggggtgtgcggcatccgcagcgccacccggctggagaacatcatgtggaagcagatctccaacgagctcaaccacatcctgctggagaacgacatgaagttcaccgtcgtggtgggggacgtcgcgggcatcctcgcccaggggaagaagatgatccgcccccagcccatggagtacaagtacagctggaagtcctggggcaaggccaagatcatcggcgccgacgtgcagaacacgaccttcatcatcgacgggcccaacaccccggagtgccccgacgaccagcgggcgtggaacatctgggaggtggaggactacggcttcgggatcttcaccacgaacatctggctgaagctgcgcgacagctacacccaggtctgcgaccaccggctcatgtccgccgccatcaaggacagcaaggccgtgcacgccgacatgggctactggatcgagtccgagaagaacgagacctggaagctggcgcgcgccagcttcatcgaggtgaagacctgcatctggcccaagtcccacacgctgtggagcaacggcgtcctcgagtccgagatgatcatccccaagatctacgggggcccgatcagccagcacaactaccggctggggtacttcacccagaccgccggcccctggcacctggggaagctcgagctggacttcgacctgtgcgagggcaccacggtggtggtcgacgagcactgcggcaaccgcgggccctccctccggaccaccaccgtgacgggcaagatcatccacgagtggtgctgccgcagctgcaccctgccgcccctgcggttccgcggggaggacggctgctggtacgggatggagatccggcccgtgaaggagaaggaggagaacctcgtcaagtccatggtgagcgccggcagcggcgaggtggactccttcagcctggggctgctctgcatctccatcatgatcgaggaggtcatgcgcagccggtggtcccgcaagatgctgatgaccggcaccctggccgtgttcctcctgctgatcatggggcagctcacgtggaacgacctgatccggctgtgcatcatggtgggcgcgaacgccagcgaccgcatggggatgggcaccacctacctcgccctgatggccaccttcaagatgcgccccatgttcgccgtcggcctgctcttccggcgcctgacgtcccgggaggtgctgctcctgaccatcgggctgagcctcgtggcgtccgtcgagctgccgaacagcctggaggagctcggcgacgggctggccatgggcatcatgatcctgaagctcctgaccgacttccagtcccaccagctgtgggccaccctcctgagcctgacgttcatcaagaccaccttctccctccactacgcctggaagaccatggcgatggtgctgagcatcgtctccctgttccccctctgcctgagcacgacctcccagaagaccacctggctgcccgtgctcctgggcagcctggggtgcaagcccctcacgatgttcctgatcgccgagaacaagatctggggccgccggtcctggccgctgaacgaggggatcatggccgtgggcatcgtcagcatcctcctgagctccctgctcaagaacgacgtgcccctggccgggcccctgatcgccggcggcatgctcatcgcgtgctacgtgatcagcgggtccagcgccgacctgtccctggagaaggccgccgaggtcagctgggaggaggaggccgagcactccggcgcgagccacaacatcctcgtggaggtgcaggacgacgggaccatgaagatcaaggacgaggagcgcgacgacaccctgaccatcctgctcaaggccaccctgctggccgtctccggcgtgtaccccctcagcatcccggccacgctgttcgtgtggtacttctggcagaagaagaagcagcggtccggggtcctgtgggacacccccagcccccccgaggtggagcgcgccgtgctggacgacggcatctaccggatcatgcagcgcggcctcctggggcggtcccaggtcggcgtgggggtgttccaggagaacgtcttccacaccatgtggcacgtgacccgcggcgcggtgctgatgtaccaggggaagcggctcgagccgagctgggcctccgtcaagaaggacctgatcagctacggcggcgggtggcgcctgcagggctcctggaacacgggggaggaggtgcaggtgatcgccgtcgagcccggcaagaaccccaagaacgtgcagaccgcccccgggaccttcaagaccccggagggcgaggtgggcgccatcgcgctcgacttcaagcccgggacgagcggctcccccatcgtcaaccgggaggggaagatcgtgggcctgtacggcaacggggtggtcaccaccagcggcacctacgtgagcgccatcgcccaggccaaggcgtcccaggaggggcccctgccggagatcgaggacgaggtgttccgcaagcggaacctcacgatcatggacctgcaccccggcagcgggaagacccgccggtacctgcccgccatcgtccgcgaggccatcaagcggaagctccgcaccctgatcctggccccgacccgcgtggtggcctccgagatggcggaggccctcaagggcatgcccatccggtaccagacgaccgccgtcaagagcgagcacaccggcaaggagatcgtggacctgatgtgccacgccaccttcacgatgcgcctgctctcccccgtgcgggtccccaactacaacatgatcatcatggacgaggcccacttcaccgacccgagctccatcgcggcccgcgggtacatcagcacccgggtgggcatgggggaggccgccgccatcttcatgaccgcgacgccccccggctccgtggaggccttcccccagagcaacgccgtcatccaggacgaggagcgcgacatcccggagcggtcctggaacagcgggtacgagtggatcaccgacttccccggcaagaccgtgtggttcgtgccctccatcaagagcggcaacgacatcgccaactgcctgcgcaagaacgggaagcgggtcatccagctgtcccgcaagaccttcgacacggagtaccagaagaccaagaacaacgactgggactacgtggtgaccaccgacatcagcgagatgggcgcgaacttccgggccgaccgcgtcatcgacccccggcgctgcctcaagccggtgatcctgaaggacgggcccgagcgggtgatcctggccggccccatgcccgtcacggtggcctccgccgcgcagcgccgggggcgcatcggccggaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgcgagaagagcgccgcgatcgacggggagtaccgcctgcggggcgaggcccgcaagaccttcgtcgagctgatgcggcgcggggacctcccggtgtggctgtcctacaaggtggccagcgagggcttccagtacagcgaccggcgctggtgcttcgacggcgagcggaacaaccaggtcctggaggagaacatggacgtggagatctggacgaaggagggggagcgcaagaagctccggccccgctggctggacgcccggacctactccgaccccctggccctccgcgagttcaaggagttcgcggccggccggcgcagcgtgtccggggacctgatcctggagatcggcaagctcccccagcacctgacccagcgggcccagaacgccctggacaacctcgtcatgctgcacaacagcgagcagggcgggcgcgcgtaccggcacgccatggaggagctgccggacaccatcgagacgctcatgctgctggccctcatcgccgtgctgaccggcggggtgaccctgttcttcctctccggccgcgggctgggcaagaccagcatcggcctgctctgcgtcatggcctccagcgtgctgctgtggatggcgtccgtggagccccactggatcgccgccagcatcatcctcgagttcttcctgatggtcctgctcatccccgagcccgaccggcagcgcaccccgcaggacaaccagctggcctacgtggtgatcgggctgctcttcatgatcctgacggtcgccgcgaacgagatgggcctgctcgagaccaccaagaaggacctggggatcggccacgtggccgtggggaaccaccaccacgccgccatgctggacgtcgacctccaccccgcctccgcgtggaccctgtacgccgtggccacgaccatcatcacccccatgatgcggcacaccatcgagaacacgaccgccaacatcagcctgaccgccatcgcgaaccaggccgccatcctcatgggcctggacaagggctggccgatctccaagatggacatcggggtgcccctgctcgccctgggctgctacagccaggtcaaccccctgaccctcacggcggccgtgctgatgctggtggcccactacgccatcatcgggcccggcctccaggccaaggcgacccgcgaggcccagaagcgcaccgccgccgggatcatgaagaacccgaccgtcgacggcatcgtggccatcgacctggaccccgtggtctacgacgcgaagttcgagaagcagctgggccagatcatgctcctgatcctgtgcacgtcccagatcctcctgatgcggaccacctgggccctgtgcgagagcatcaccctcgccacggggcccctgaccaccctgtgggagggctcccccgggaagttctggaacaccacgatcgccgtgagcatggccaacatcttccgcggctcctacctcgcgggcgccgggctggccttcagcctgatgaagagcctcggcgggggccggcgcgggaccggcgcccagggcgagaccctgggggagaagtggaagcggcagctgaaccagctctccaagagcgagttcaacacctacaagcgctccggcatcatggaggtggaccggagcgaggcgaaggaggggctgaagcgcggcgagacgaccaagcacgccgtctcccgggggaccgccaagctgcgctggttcgtggagcggaacctggtgaagccggagggcaaggtcatcgacctcggctgcgggcgcggcgggtggagctactactgcgccggcctgaagaaggtgaccgaggtgaaggggtacacgaagggcggccccgggcacgaggagcccatccccatggccacctacggctggaacctggtcaagctccactccgggaaggacgtgttcttcatcccgcccgagaagtgcgacaccctgctgtgcgacatcggcgagagctcccccaaccccaccatcgaggaggggcggacgctccgcgtgctgaagatggtcgagccgtggctgcggggcaaccagttctgcatcaagatcctcaacccctacatgcccagcgtggtggagaccctggagcagatgcagcgcaagcacggcgggatgctggtccggaaccccctctcccgcaacagcacccacgagatgtactgggtgtcctgcggcaccgggaacatcgtgagcgcggtcaacatgacctcccggatgctgctgaaccgcttcacgatggcccaccgcaagccgacctacgagcgggacgtggacctcggcgccggcacccgccacgtggccgtcgagcccgaggtggccaacctggacatcatcgggcagcggatcgagaacatcaagcacgagcacaagagcacctggcactacgacgaggacaacccctacaagacgtgggcgtaccacggctcctacgaggtgaagcccagcgggtccgccagcagcatggtcaacggcgtggtcaagctgctcaccaagccgtgggacgtgatccccatggtgacccagatcgccatgaccgacacgacccccttcgggcagcagcgcgtcttcaaggagaaggtggacacccggacccccaaggccaagcgcggcacggcccagatcatggaggtgaccgcgaagtggctgtggggcttcctgtcccggaacaagaagccgcgcatctgcacccgggaggagttcacccgcaaggtccggagcaacgccgccatcggggccgtgttcgtggacgagaaccagtggaactccgcgaaggaggccgtcgaggacggccgcttctgggacctcgtgcaccgggagcgcgagctgcacaagcaggggaagtgcgccacgtgcgtgtacaacatgatgggcaagcgggagaagaagctgggggagttcggcaaggccaagggcagccgcgccatctggtacatgtggctcggggcgcggttcctggagttcgaggccctgggcttcatgaacgaggaccactggttctcccgcgagaacagcctctccggggtcgagggcgaggggctgcacaagctgggctacatcctccgggacatcagcaagatccccggcgggaacatgtacgccgacgacaccgccggctgggacacccgcatcaccgaggacgacctgcagaacgaggcccggatcacggacatcatggagcccgagcacgcgctgctcgccaagtccatcttcaagctgacctaccagaacaaggtggtgcgcgtccagcgcccggccaagaacgggaccgtgatggacgtgatcagccggcgcgaccagcggggctccggccaggtcgggacctacggcctgaacacgttcaccaacatggaggcccagctcatccgccagatggagagcgaggggatcttctcccccagcgagctggagacccccaacctggccgagcgggtgctcgactggctggagaagtacggcgtggagcgcctgaagcggatggcgatctccggggacgactgcgtcgtgaagcccatcgacgaccgcttcgccaccgccctcacggccctgaacgacatgggcaaggtgcggaaggacatcccgcagtgggagcccagcaagggctggaacgactggcagcaggtccccttctgctcccaccacttccaccagctgatcatgaaggacgggcgcgagatcgtggtgccctgccggaaccaggacgagctcgtcggccgcgcccgggtgagccagggggcgggctggagcctgcgcgagaccgcctgcctggggaagtcctacgcccagatgtggcagctcatgtacttccaccggcgcgacctgcggctggccgcgaacgccatctgcagcgccgtgccggtcgactggatccccacctcccgcaccacgtggagcatccacgcccaccaccagtggatgaccaccgaggacatgctctccgtgtggaaccgggtgtggatcgaggagaacccctggatggaggacaagacccacatcagctcctggggcgacgtcccctacctgggcaagcgcgaggaccagtggtgcgggagcctgatcggcctcacggcccgcgcgacctgggccaccaacatccaggtggccatcaaccaggtgcggcgcctgatcgggaacgagaactacctggactacatgacctccatgaagcggttcaagaacgagagcgacccggagggcgccctctggtga

SEQ ID NO: 8051 - RNA, 9879 nt, synthetic construct
  misc_feature 1..9879: note = derived and/or modified CDS sequence (opt1) from DENV-1__HM181954__SS-prME
  source 1..9879: mol_type = other RNA
agcgtgaccatgctgctcatgctgatgcccaccgccctggccttccacctcaccacccggggcggggagccgcacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggacccccggggccagcaccagccaggagacgtggaaccggcaggacctgctggtgaccttcaagaccgcccacgcgaagaagcaggaggtggtcgtgctcggctcccaggagggcgccatgcacaccgccctgacgggggccaccgagatccagaccagcggcaccacgaccatcttcgccgggcacctgaagtgccgcctcaagatggacaagctgaccctgaagggcatgtcctacgtgatgtgcaccgggagcttcaagctcgagaaggaggtcgcggagacgcagcacggcaccgtgctggtgcagatcaagtacgagggcaccgacgccccctgcaagatcccgttctccacccaggacgagaagggggtcacgcagaacggccggctgatcaccgccaaccccatcgtgaccgacaaggagaagcccgtgaacatcgaggccgagcccccgttcggggagagctacatcgtcatcggcgcgggcgagaaggccctgaagctctcctggttcaagaaggggagctccatcggcaagatgttcgaggccaccgcccgcggggcccggcgcatggcgatcctgggcgacacggcctgggacttcgggagcatcggcggcgtgttcacctccgtggggaagctggtccaccagatcttcggcgccgcctacggggtcctcttcagcggcgtgtcctggaccatgaagatcgggatcggcgtcctgctgacctggctcggcctgaacagccgctccacgagcctgtccatgacctgcatcgccgtggggctcgtgaccctgtacctgggcgtcatggtgcaggcggacagcgggtgcgtgatcaactggaagggccgggagctcaagtgcgggtccggcatcttcgtcaccaacgaggtgcacacgtggaccgagcagtacaagttccaggccgacagccccaagcgcctgagcgccgccatcggcaaggcctgggaggagggggtgtgcggcatccggtccgcgacccgcctggagaacatcatgtggaagcagatcagcaacgagctcaaccacatcctgctggagaacgacatgaagttcaccgtcgtggtgggggacgtcgccggcatcctcgcccaggggaagaagatgatccggccccagcccatggagtacaagtactcctggaagtcctggggcaaggccaagatcatcggcgcggacgtgcagaacaccacgttcatcatcgacgggccgaacacccccgagtgccccgacgaccagcgcgcctggaacatctgggaggtggaggactacggcttcgggatcttcaccaccaacatctggctgaagctgcgggactcctacacgcaggcctgcgaccaccgcctcatgagcgccgccatcaaggactccaaggcggtccacgccgacatgggctactggatcgagagcgagaagaacgagacctggaagctggcccgggcctccttcatcgaggtgaagacctgcatctggcccaagagccacaccctgtggtccaacggcgtgctcgagagcgagatgatcatcccgaagatctacgggggccccatctcccagcacaactaccgccccgggtacttcacgcagaccgccggcccgtggcacctggggaagctggagctcgacttcgacctgtgcgagggcaccaccgtcgtggtggacgagcactgcggcaaccgggggcccagcctgcgcacgaccaccgtcaccggcaagatcatccacgagtggtgctgccggtcctgcacgctgccgcccctccgcttccgcggggaggacggctgctggtacgggatggagatccgcccggtgaaggagaaggaggagaacctggtcaagagcatggtctccgcgggcagcggcgaggtggacagcttctccctcgggctgctgtgcatcagcatcatgatcgaggaggtgatgcggtcccgctggagccggaagatgctcatgaccggcaccctggccgtcttcctgctcctgatcatggggcagctgacctggaacgacctcatccgcctgtgcatcatggtgggcgccaacgcctccgaccgcatggggatgggcacgacctacctggccctcatggcgaccttcaagatgcggcccatgttcgccgtggggctgctgttccgccggctcaccagccgcgaggtcctgctgctcacgatcgggctgtccctggtggccagcgtggagctccccaactccctggaggagctgggcgacgggctcgccatgggcatcatgatcctgaagctgctcaccgacttccagagccaccagctgtgggcgaccctgctctccctgaccttcatcaagacgaccttcagcctgcactacgcctggaagaccatggccatggtcctctccatcgtgagcctgttccccctgtgcctctccaccacgagccagaagaccacctggctgccggtcctgctcggctccctggggtgcaagcccctgaccatgttcctcatcgccgagaacaagatctggggccggcgcagctggcccctgaacgaggggatcatggccgtgggcatcgtgtccatcctgctcagcagcctgctgaagaacgacgtccccctcgcggggccgctgatcgccggcggcatgctgatcgcctgctacgtgatctccgggagctccgccgacctcagcctggagaaggccgcggaggtgtcctgggaggaggaggccgagcacagcggcgcctcccacaacatcctggtcgaggtgcaggacgacgggacgatgaagatcaaggacgaggagcgggacgacaccctcaccatcctgctgaaggccaccctcctggccgtgagcggcgtctaccccctgtccatccccgcgaccctcttcgtgtggtacttctggcagaagaagaagcagcgcagcggggtgctgtgggacacgccctccccgcccgaggtcgagcgggccgtgctggacgacggcatctaccgcatcatgcagcggggcctgctcgggcgcagccaggtgggcgtcggggtgttccaggagaacgtgttccacaccatgtggcacgtcacccggggcgccgtgctgatgtaccaggggaagcgcctggagccctcctgggccagcgtgaagaaggacctcatctcctacggcggcgggtggcggctgcagggcagctggaacaccggggaggaggtccaggtgatcgccgtggagcccggcaagaacccgaagaacgtccagacggcgcccgggaccttcaagacccccgagggcgaggtgggcgccatcgccctggacttcaagcccgggacctccggcagcccgatcgtgaaccgcgaggggaagatcgtcggcctctacggcaacggggtggtgacgacctccggcacctacgtcagcgccatcgcgcaggccaaggccagccaggaggggcccctgcccgagatcgaggacgaggtgttccggaagcgcaacctgaccatcatggacctccacccgggctccgggaagacgcggcgctacctgcccgccatcgtgcgggaggccatcaagcgcaagctgcgcaccctcatcctggcgcccacccgggtcgtggccagcgagatggccgaggccctgaagggcatgcccatccgctaccagaccacggccgtgaagtccgagcacaccggcaaggagatcgtcgacctcatgtgccacgcgaccttcaccatgcggctgctgagcccggtgcgcgtgcccaactacaacatgatcatcatggacgaggcccacttcacggacccctccagcatcgccgcccgggggtacatctccacccgcgtcggcatgggggaggccgcggccatcttcatgaccgccacgccgcccggcagcgtggaggccttcccccagtccaacgcggtgatccaggacgaggagcgggacatccccgagcgcagctggaactccgggtacgagtggatcacggacttccccggcaagaccgtctggttcgtgcccagcatcaagtccggcaacgacatcgccaactgcctccggaagaacgggaagcgcgtgatccagctgagccggaagaccttcgacaccgagtaccagaagacgaagaacaacgactgggactacgtcgtgaccaccgacatctccgagatgggcgccaacttccgcgccgaccgggtgatcgacccccgccggtgcctgaagcccgtcatcctcaaggacgggcccgagcgcgtgatcctggccggcccgatgcccgtgaccgtcgcgagcgccgcccagcggcgcgggcggatcggccgcaaccacaacaaggagggcgaccagtacatctacatggggcagcccctgaacaacgacgaggaccacgcccactggacggaggccaagatgctcctggacaacatcaacacccccgagggcatcatcccggcgctgttcgagcccgagcgcgagaagtccgccgccatcgacggggagtaccggctccgcggcgaggcccggaagaccttcgtggagctgatgcgccgcggggacctgcccgtctggctcagctacaaggtggcctccgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcgcgcacgtacagcgacccgctggccctgcgggagttcaaggagttcgccgccggccgccggtccgtgagcggggacctcatcctggagatcggcaagctgccccagcacctcacccagcgcgcgcagaacgccctggacaacctggtgatgctccacaactccgagcagggcgggcgggcctaccgccacgccatggaggagctgcccgacaccatcgagaccctgatgctcctggccctgatcgcggtcctcacgggcggggtgaccctgttcttcctgagcggccgggggctcggcaagacctccatcggcctgctgtgcgtgatggccagctccgtcctcctgtggatggccagcgtggagccccactggatcgccgcctccatcatcctggagttcttcctcatggtgctgctgatcccggagcccgaccgccagcggacgccccaggacaaccagctcgcgtacgtcgtgatcgggctgctgttcatgatcctcaccgtggccgccaacgagatgggcctgctggagacgaccaagaaggacctcgggatcggccacgtcgccgtggggaaccaccaccacgccgcgatgctggacgtggacctgcacccggccagcgcctggaccctctacgccgtcgccaccacgatcatcacccccatgatgcgccacaccatcgagaacaccacggcgaacatctccctgaccgccatcgccaaccaggccgcgatcctgatgggcctcgacaagggctggcccatcagcaagatggacatcggggtgcccctgctggccctcggctgctactcccaggtgaacccgctgaccctgaccgccgccgtcctcatgctggtggcccactacgcgatcatcgggcccggcctgcaggccaaggccacgcgcgaggcccagaagcggaccgccgcggggatcatgaagaaccccaccgtggacggcatcgtcgccatcgacctcgaccccgtggtgtacgacgccaagttcgagaagcagctgggccagatcatgctgctcatcctgtgcaccagccagatcctgctcatgcgcacgacctgggccctgtgcgagtccatcaccctggccaccgggccgctcacgaccctgtgggagggcagccccgggaagttctggaacaccaccatcgcggtctccatggccaacatcttccggggcagctacctggccggcgccgggctcgcgttctccctgatgaagtccctgggcgggggccgccgggggacgggcgcccagggcgagaccctcggggagaagtggaagcgccagctgaaccagctgagcaagtccgagttcaacacctacaagcggagcggcatcatggaggtggaccgctccgaggccaaggaggggctcaagcggggcgagaccacgaagcacgccgtgagccgcgggaccgccaagctgcggtggttcgtcgagcgcaacctggtgaagcccgagggcaaggtgatcgacctgggctgcgggcggggcgggtggtcctactactgcgcgggcctcaagaaggtcaccgaggtgaaggggtacaccaagggcggccccgggcacgaggagccgatccccatggccacgtacggctggaacctggtgaagctgcacagcgggaaggacgtcttcttcatcccgcccgagaagtgcgacaccctcctgtgcgacatcggcgagtccagcccgaaccccaccatcgaggaggggcgcaccctgcgggtgctcaagatggtggagccctggctgcgcggcaaccagttctgcatcaagatcctgaacccctacatgccgtccgtcgtggagacgctcgagcagatgcagcggaagcacggcgggatgctggtgcgcaaccccctgagccggaactccacccacgagatgtactgggtcagctgcggcaccgggaacatcgtgtccgccgtgaacatgaccagccgcatgctcctgaaccgcttcaccatggcccaccggaagcccacgtacgagcgcgacgtcgacctgggcgccggcacccggcacgtggcggtggagcccgaggtcgccaacctcgacatcatcgggcagcgcatcgagaacatcaagcacgagcacaagtccacctggcactacgacgaggacaacccgtacaagacctgggcctaccacggcagctacgaggtgaagccctccgggagcgcctccagcatggtgaacggcgtcgtgaagctgctgacgaagccctgggacgtcatccccatggtgacccagatcgccatgaccgacaccacgccgttcgggcagcagcgggtgttcaaggagaaggtcgacacccgcacccccaaggcgaagcggggcaccgcccagatcatggaggtgacggccaagtggctctggggcttcctgagccgcaacaagaagccccggatctgcacccgcgaggagttcacccggaaggtgcgctccaacgccgcgatcggggccgtcttcgtggacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggcgaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgccgacgacacggcggggtgggacacccggatcaccgaggacgacctccagaacgaggcccgcatcaccgacatcatggagcccgagcacgccctgctggccaagagcatcttcaagctcacgtaccagaacaaggtcgtgcgcgtgcagcggcccgccaagaacggcaccgtcatggacgtgatctcccgccgggaccagcgcgggagcggccaggtgggcacctacgggctgaacaccttcacgaacatggaggcgcagctgatccggcagatggagtccgagggcatcttcagcccctccgagctcgagaccccgaacctggccgagcgcgtcctggactggctcgagaagtacggggtggagcggctgaagcgcatggccatcagcggcgacgactgcgtggtcaagcccatcgacgaccggttcgccaccgccctgaccgcgctcaacgacatggggaaggtgcgcaaggacatcccccagtgggagccctccaagggctggaacgactggcagcaggtcccgttctgcagccaccacttccaccagctgatcatgaaggacggccgggagatcgtcgtgccctgccgcaaccaggacgagctggtggggcgggcccgcgtctcccagggcgccgggtggagcctccgggagacggcctgcctgggcaagagctacgcgcagatgtggcagctgatgtacttccaccgccgggacctccgcctggccgccaacgccatctgctccgccgtgcccgtggactggatccccaccagccggaccacctggtccatccacgcgcaccaccagtggatgacgaccgaggacatgctgagcgtctggaaccgcgtgtggatcgaggagaacccgtggatggaggacaagacccacatctccagctggggcgacgtgccctacctcggcaagcgcgaggaccagtggtgcggctccctgatcgggctgaccgcccgggccacgtgggccaccaacatccaggtcgccatcaaccaggtgcgccggctcatcggcaacgagaactacctggactacatgaccagcatgaagcgcttcaagaacgagtccgaccccgagggggcgctgtggtga

SEQ ID NO: 8052 - RNA, 9879 nt, synthetic construct
  misc_feature 1..9879: note = derived and/or modified CDS sequence (opt1) from DENV-1__HM181955__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctcgcgccccacgtgggcctggggctggagacgcgcaccgagacctggatgagctccgagagcgcctggaagcagatccagcgggtcgagacctgggccctccgccaccccggcttcacggtgatcgccctgttcctggcgcacgccatcgggacctccatcacccagaagggcatcatcttcatcctcctgatgctggtgacccccagcatggccatgcggtgcgtcgggatcggctcccgcgacttcgtggagggcctcagcggggccacgtgggtggacgtcgtgctggagcacggctcctgcgtgaccaccatggccaaggacaagcccaccctggacatcgagctcctgaagacggaggtcaccaaccccgcgatcctgcggaagctctgcatcgaggccaagatcagcaacaccaccacggactcccgctgcccgacccagggggaggccaccctggtggaggagcaggacgccaacttcgtgtgccggcgcaccttcgtcgaccggggctggggcaacgggtgcggcctgttcgggaagggcagcctcatcacgtgcgccaagttcaagtgcgtgaccaagctggaggggaagatcgtgcagtacgagaacctgaagtactccgtcatcgtgaccgtgcacaccggcgaccagcaccaggtcggcaacgagagcacggagcacgggaccaccgcgaccatcacgccccaggcccccacgaccgagatccagctcaccgactacggcgccctgaccctggactgcagcccccggacggggctcgacttcaacgagatggtgctgctgaccatgaaggagaagtcctggctcgtccacaagcagtggttcctggacctgcccctcccctggaccagcggcgcctccaccagccaggagacgtggaaccggcaggacctgctggtgaccttcaagaccgcccacgcgaagaagcaggaggtggtcgtgctcgggtcccaggagggcgccatgcacaccgccctgacgggcgccaccgagatccagaccagcgggaccacgaccatcttcgccggccacctgaagtgccgcctcaagatggacaagctgaccctgaaggggatgtcctacgtgatgtgcaccggcagcttcaagctcgagaaggaggtcgcggagacgcagcacgggaccgtgctggtgcagatcaagtacgagggcaccgacgccccctgcaagatccccttctccacccaggacgagaagggcgtcacgcagaacgggcggctgatcaccgccaacccgatcgtgaccgacaaggagaagcccgtgaacatcgaggccgagccgcccttcggcgagagctacatcgtcatcggggcgggcgagaaggccctgaagctctcctggttcaagaagggcagctccatcgggaagatgttcgaggccaccgcccgcggcgcccggcgcatggcgatcctgggggacacggcctgggacttcggcagcatcgggggcgtgttcacctccgtgggcaagctggtccaccagatcttcgggaccgcctacggcgtgctgttcagcggggtgtcctggaccatgaagatcggcatcggggtcctgctgacgtggctcggcctgaacagccgctccaccagcctgtccatgacctgcatcgccgtgggcctcgtgaccctgtacctgggggtcatggtgcaggccgacagcggctgcgtgatcaactggaaggggcgggagctcaagtgcggcagcgggatcttcgtcacgaacgaggtgcacacctggaccgagcagtacaagttccaggcggactccccgaagcgcctgagcgccgccatcggcaaggcctgggaggagggcgtgtgcgggatccggtccgccacccgcctggagaacatcatgtggaagcagatcagcaacgagctcaaccacatcctgctggagaacgacatgaagttcaccgtcgtggtgggcgacgtcgcggggatcctcgcccagggcaagaagatgatccggccccagcccatggagtacaagtactcctggaagtcctgggggaaggccaagatcatcggcgccgacgtgcagaacacgaccttcatcatcgacggccccaacaccccggagtgccccgacgaccagcgcgcgtggaacatctgggaggtggaggactacgggttcggcatcttcaccacgaacatctggctgaagctgcgggactcctacacccaggtctgcgaccaccgcctcatgagcgccgccatcaaggactccaaggccgtgcacgccgacatggggtactggatcgagagcgagaagaacgagacctggaagctggcgcgggcctccttcatcgaggtgaagacctgcatctggcccaagagccacacgctgtggtccaacggcgtcctcgagagcgagatgatcatccccaagatctacggcgggccgatctcccagcacaactaccgccccggctacttcacccagaccgccgggccctggcacctgggcaagctggagctcgacttcgacctgtgcgaggggaccacggtggtggtcgacgagcactgcggcaaccggggcccgagcctgcgcaccaccaccgtgacggggaagatcatccacgagtggtgctgccggtcctgcaccctgccgcccctccgcttccggggcgaggacgggtgctggtacggcatggagatccgccccgtgaaggagaaggaggagaacctggtcaagagcatggtgagcgccgggtccggcgaggtggacagcttctccctcggcctgctgtgcatcagcatcatgatcgaggaggtcatgcggtcccgctggagccggaagatgctcatgaccgggaccctggtggtgttcctgctcctgatcatgggccagctgacgtggaacgacctcatccgcctgtgcatcatggtcggggccaacgcgtccgaccgcatgggcatggggaccacctacctggccctcatggccaccttcaagatgcggccgatgttcgccgtgggcctgctgttccgccggctcacgagccgcgaggtgctgctgctcaccatcggcctgtccctggtcgccagcgtggagctccccaactccctggaggagctgggggacggcctcgcgatggggatcatgatcctgaagctgctcaccgacttccagagccaccagctgtgggccaccctgctctccctgacgttcatcaagaccaccttcagcctgcactacgcctggaagaccatggccatggtcctctccatcgtgagcctgttccccctgtgcctctccacgaccagccagaagaccacctggctgcccgtgctgctcggctccctgggctgcaagccgctgacgatgttcctcatcgcggagaacaagatctgggggcggcgcagctggcccctgaacgagggcatcatggccgtcgggatcgtgagcatcctgctctccagcctgctgaagaacgacgtgcccctcgccggccccctgatcgccgggggcatgctgatcgcctgctacgtcatctccggcagctccgcggacctcagcctggagaaggccgccgaggtgtcctgggaggaggaggccgagcacagcggggcctcccacaacatcctggtggaggtccaggacgacggcaccatgaagatcaaggacgaggagcgggacgacaccctcaccatcctgctgaaggcgaccctcctggccgtgagcggggtgtacccgctgtccatccccgccaccctcttcgtctggtacttctggcagaagaagaagcagcgcagcggcgtgctgtgggacacccccagcccgcccgaggtggagcgggccgtcctggacgacgggatctaccgcatcatgcagcggggcctgctcggccgcagccaggtgggggtgggcgtcttccaggagaacgtgttccacaccatgtggcacgtgacccgcggggcggtcctgatgtaccagggcaagcgcctggagccctcctgggcgagcgtgaagaaggacctcatctcctacgggggcggctggcggctgcaggggagctggaacacgggcgaggaggtgcaggtcatcgccgtggagcccgggaagaaccccaagaacgtgcagaccgcccccggcaccttcaagacccccgagggggaggtcggcgccatcgccctggacttcaagcccggcacgtccgggagccccatcgtgaaccgcgagggcaagatcgtggggctctacggcaacggcgtcgtgaccaccagcgggacctacgtgtccgcgatcgcccaggccaaggccagccaggagggcccgctgcccgagatcgaggacgaggtcttccggaagcgcaacctgacgatcatggacctccaccccgggtccggcaagacccggcgctacctgccggcgatcgtgcgggaggccatcaagcgcaagctgcgcaccctcatcctggcccccacccgggtggtcgccagcgagatggccgaggcgctgaaggggatgcccatccgctaccagacgaccgccgtgaagtccgagcacaccggcaaggagatcgtggacctcatgtgccacgccaccttcacgatgcggctgctgagccccgtccgcgtgccgaactacaacatgatcatcatggacgaggcccacttcaccgacccctccagcatcgccgcgcggggctacatctccacccgcgtggggatgggcgaggccgccgccatcttcatgaccgccacgccgcccgggagcgtcgaggcgttcccgcagtccaacgccgtgatccaggacgaggagcgggacatccccgagcgcagctggaactccggctacgagtggatcaccgacttccccgggaagaccgtgtggttcgtccccagcatcaagtccggcaacgacatcgccaactgcctccggaagaacggcaagcgcgtgatccagctgagccggaagaccttcgacacggagtaccagaagaccaagaacaacgactgggactacgtggtcaccaccgacatctccgagatgggggccaacttccgcgcggaccgggtgatcgacccgcgccggtgcctgaagcccgtgatcctcaaggacggccccgagcgcgtcatcctggccgggcccatgccggtgacggtcgccagcgccgcccagcggcgcggccggatcgggcgcaaccacaacaaggagggcgaccagtacatctacatgggccagcccctgaacaacgacgaggaccacgcgcactggaccgaggccaagatgctcctggacaacatcaacacccccgaggggatcatccccgccctgttcgagccggagcgcgagaagtccgccgccatcgacggcgagtaccggctccgcggggaggcgcggaagaccttcgtggagctgatgcgccggggcgacctgcccgtgtggctcagctacaaggtcgccagcgaggggttccagtactccgaccgccggtggtgcttcgacggcgagcgcaacaaccaggtgctggaggagaacatggacgtggagatctggacgaaggagggcgagcggaagaagctgcgcccccggtggctcgacgcccgcacctacagcgaccccctggccctgcgggagttcaaggagttcgccgcggggcgccggtccgtcagcggcgacctcatcctggagatcgggaagctgccgcagcacctcacccagcgcgcccagaacgccctggacaacctggtgatgctccacaactccgagcagggcggccgggcctaccgccacgcgatggaggagctgcccgacaccatcgagacgctgatgctcctggccctgatcgccgtgctcaccgggggcgtcaccctgttcttcctgagcgggcggggcctcgggaagacctccatcggcctgctgtgcgtgatggccagctccgtgctcctgtggatggccagcgtcgagccccactggatcgcggcctccatcatcctggagttcttcctcatggtgctgctgatccccgagccggaccgccagcggacgccccaggacaaccagctcgcctacgtggtcatcggcctgctgttcatgatcctcacggtggccgccaacgagatggggctgctggagaccaccaagaaggacctcggcatcgggcacgtggcggtcggcaaccaccaccacgccgccatgctggacgtggacctgcaccccgccagcgcctggaccctctacgcggtggccacgaccatcatcaccccgatgatgcgccacaccatcgagaacacgaccgccaacatctccctgaccgccatcgccaaccaggcggccatcctgatggggctcgacaagggctggcccatcagcaagatggacatcggcgtccccctgctggccctcgggtgctactcccaggtgaaccccctgaccctgacggccgcggtgctcatgctggtcgcccactacgccatcatcggcccggggctgcaggccaaggccacccgcgaggcgcagaagcggaccgccgccggcatcatgaagaaccccaccgtggacgggatcgtggccatcgacctcgaccccgtcgtgtacgacgccaagttcgagaagcagctgggccagatcatgctgctcatcctgtgcacgagccagatcctgctcatgcgcaccacctgggcgctgtgcgagtccatcaccctggccacgggccccctcaccaccctgtgggaggggagcccgggcaagttctggaacaccacgatcgccgtgtccatggccaacatcttccgggggagctacctggccggcgcgggcctcgccttcagcctgatgaagtccctcgggggcgggcgccgggggaccggggcccagggcgagaccctcggcgagaagtggaagcgccagctgaaccagctgagcaagtccgagttcaacacctacaagcggagcgggatcatggaggtcgaccgctccgaggccaaggagggcctcaagcgcggggagacgaccaagcacgcggtgagccgcggcaccgccaagctgcggtggttcgtggagcgcaacctggtcaagcccgaggggaaggtgatcgacctgggctgcggccgcggcgggtggtcctactactgcgccgggctcaagaaggtgaccgaggtcaaggggtacacgaagggcgggcccggccacgaggagcccatcccgatggccacctacgggtggaacctggtgaagctgcacagcggcaaggacgtgttcttcatcccgcccgagaagtgcgacaccctcctgtgcgacatcggggagtccagccccaacccgaccatcgaggagggccgcacgctgcgggtcctcaagatggtggagccctggctgcgcgggaaccagttctgcatcaagatcctgaacccctacatgccctccgtggtcgagaccctcgagcagatgcagcggaagcacggcggcatgctggtgcgcaacccgctgagccggaactccacccacgagatgtactgggtgagctgcgggaccggcaacatcgtctccgccgtgaacatgaccagccgcatgctcctgaaccgcttcacgatggcgcaccggaagcccacctacgagcgcgacgtggacctgggggccggcacccggcacgtcgccgtggagcccgaggtggccaacctcgacatcatcggccagcgcatcgagaacatcaagcacgagcacaagtccacctggcactacgacgaggacaacccctacaagacgtgggcctaccacgggagctacgaggtcaagccgtccggcagcgcgagctccatggtgaacggggtcgtgaagctgctgaccaagccctgggacgtgatccccatggtcacccagatcgccatgaccgacacgacccccttcggccagcagcgggtgttcaaggagaaggtggacacccgcaccccgaaggccaagcgggggacggcccagatcatggaggtcaccgccaagtggctctggggcttcctgagccgcaacaagaagccccggatctgcacccgcgaggagttcacccggaaggtgcgctccaacgcggccatcggcgccgtgttcgtcgacgagaaccagtggaacagcgccaaggaggcggtggaggacgagcggttctgggacctggtgcaccgcgagcgggagctccacaagcaggggaagtgcgccacgtgcgtctacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtggagggcgaggggctccacaagctgggctacatcctgcgcgacatctccaagatccccgggggcaacatgtacgccgacgacaccgccggctgggacacccggatcaccgaggacgacctccagaacgaggcccgcatcacggacatcatggagccggagcacgccctgctggccaagagcatcttcaagctcacctaccagaacaaggtggtccgcgtgcagcggcccgccaagaacgggaccgtgatggacgtcatctcccgccgggaccagcgcggcagcggccaggtgggcacctacggcctgaacacgttcaccaacatggaggcccagctgatccggcagatggagtccgaggggatcttcagcccctccgagctcgagacccccaacctggccgagcgcgtgctggactggctcgagaagtacggcgtcgagcggctgaagcgcatggccatcagcggggacgactgcgtggtgaagccgatcgacgaccggttcgcgaccgccctgacggccctcaacgacatgggcaaggtccgcaaggacatcccccagtgggagccctccaaggggtggaacgactggcagcaggtccccttctgcagccaccacttccaccagctgatcatgaaggacggccgggagatcgtggtcccgtgccgcaaccaggacgagctggtgggccgggcccgcgtgagccagggggccggctggtccctccgggagaccgcgtgcctgggcaagagctacgcccagatgtggcagctgatgtacttccaccgccgggacctccgcctggccgccaacgcgatctgctccgccgtccccgtggactggatccccaccagccggaccacgtggtccatccacgcccaccaccagtggatgaccaccgaggacatgctgagcgtgtggaaccgcgtctggatcgaggagaacccctggatggaggacaagacccacatctccagctggggcgacgtgccgtacctcgggaagcgcgaggaccagtggtgcggctccctgatcggcctgacggcccgggccacctgggcgaccaacatccaggtggccatcaaccaggtccgccggctcatcgggaacgagaactacctggactacatgaccagcatgaagcgcttcaagaacgagtccgaccccgagggcgccctgtggtga

SEQ ID NO: 8053 - RNA, 9879 nt, synthetic construct
  misc_feature 1..9879: note = derived and/or modified CDS sequence (opt1) from DENV-1__HM181959__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctcgcgccccacgtgggcctggggctggagacgcgcaccgagacctggatgagctccgagagcgcctggaagcagatccagcgggtcgagacctgggccctccgccaccccggcttcacggtgatcgccctgttcctggcgcacgccatcgggacctccatcacccagaagggcatcatcttcatcctcctgatgctggtgacccccagcatggccatgcggtgcgtcgggatcggctcccgcgacttcgtggagggcctcagcggggccacgtgggtggacgtcgtgctggagcacggctcctgcgtgaccaccatggccaaggacaagcccaccctggacatcgagctcctgaagacggaggtcaccaaccccgcgatcctgcggaagctctgcatcgaggccaagatcagcaacaccaccacggactcccgctgcccgacccagggggaggccaccctggtggaggagcaggacgccaacttcgtgtgccggcgcaccttcgtcgaccggggctggggcaacgggtgcggcctgttcgggaagggcagcctcatcacgtgcgccaagttcaagtgcgtgaccaagctggaggggaagatcgtgcagtacgagaacctgaagtactccgtcatcgtgaccgtgcacaccggcgaccagcaccaggtcggcaacgagagcacggagcacgggaccaccgcgaccatcacgccccaggcccccacgaccgagatccagctcaccgactacggcgccctgaccctggactgcagcccccggacggggctcgacttcaacgagatggtgctgctgaccatgaaggagaagtcctggctcgtccacaagcagtggttcctggacctgcccctcccctggaccagcggcgcctccaccagccaggagacgtggaaccggcaggacctgctggtgaccttcaagaccgcccacgcgaagaagcaggaggtggtcgtgctcgggtcccaggagggcgccatgcacaccgccctgacgggcgccaccgagatccagaccagcgggaccacgaccatcttcgccggccacctgaagtgccgcctcaagatggacaagctgaccctgaaggggatgtcctacgtgatgtgcaccggcagcttcaagctcgagaaggaggtcgcggagacgcagcacgggaccgtgctggtgcagatcaagtacgagggcaccgacgccccctgcaagatccccttctccacccaggacgagaagggcgtcacgcagaacgggcggctgatcaccgccaacccgatcgtgaccgacaaggagaagcccgtgaacatcgaggccgagccgcccttcggcgagagctacatcgtcatcggggcgggcgagaaggccctgaagctctcctggttcaagaagggcagctccatcgggaagatgttcgaggccaccgcccgcggcgcccggcgcatggcgatcctgggggacacggcctgggacttcggcagcatcgggggcgtgttcacctccgtgggcaagctggtccaccagatcttcgggaccgcctacggcgtgctgttcagcggggtgtcctggaccatgaagatcggcatcggggtcctgctgacgtggctcggcctgaacagccgctccaccagcctgtccatgacctgcatcgccgtgggcctcgtgaccctgtacctgggggtcatggtgcaggccgacagcggctgcgtgatcaactggaaggggcgggagctcaagtgcggcagcgggatcttcgtcacgaacgaggtgcacacctggaccgagcagtacaagttccaggcggactccccgaagcgcctgagcgccgccatcggcaaggcctgggaggagggcgtgtgcgggatccggtccgccacccgcctggagaacatcatgtggaagcagatcagcaacgagctcaaccacatcctgctggagaacgacatgaagttcaccgtcgtggtgggcgacgtcgcggggatcctcgcccagggcaagaagatgatccggccccagcccatggagtacaagtactcctggaagtcctgggggaaggccaaggtgatcggcgccgacgtgcagaacacgaccttcatcatcgacggccccaacaccccggagtgccccgacgaccagcgcgcgtggaacatctgggaggtcgaggactacgggttcggcatcttcaccacgaacatctggctgaagctgcgggactcctacacccaggtgtgcgaccaccgcctcatgagcgccgccatcaaggactccaaggccgtgcacgccgacatggggtactggatcgagagcgagaagaacgagacctggaagctggcgcgggcctccttcatcgaggtcaagacctgcatctggcccaagagccacacgctgtggtccaacggcgtgctcgagagcgagatgatcatccccaagatctacggcgggccgatctcccagcacaactaccgccccggctacttcacccagaccgccgggccctggcacctgggcaagctggagctcgacttcgacctgtgcgaggggaccacggtggtcgtggacgagcactgcggcaaccggggcccgagcctgcgcaccaccaccgtgacggggaagatcatccacgagtggtgctgccggtcctgcaccctgccgcccctccgcttccggggcgaggacgggtgctggtacggcatggagatccgccccgtcaaggagaaggaggagaacctggtcaagagcatggtgagcgccgggtccggcgaggtcgacagcttctccctcggcctgctgtgcatcagcatcatgatcgaggaggtgatgcggtcccgctggagccggaagatgctcatgaccgggaccctggtggtcttcctgctcctgatcatgggccagctgacgtggaacgacctcatccgcctgtgcatcatggtgggggccaacgcgtccgaccgcatgggcatggggaccacctacctggccctcatggccaccttcaagatgcggccgatgttcgccgtgggcctgctgttccgccggctcacgagccgcgaggtcctgctgctcaccatcggcctgtccctggtggccagcgtcgagctccccaactccctggaggagctgggggacggcctcgcgatggggatcatgatcctgaagctgctcaccgacttccagagccaccagctgtgggccaccctgctctccctgacgttcatcaagaccaccttcagcctgcactacgcctggaagaccatggccatggtgctctccatcgtgagcctgttccccctgtgcctctccacgaccagccagaagaccacctggctgcccgtcctgctcggctccctgggctgcaagccgctgacgatgttcctcatcgcggagaacaagatctgggggcggcgcagctggcccctgaacgagggcatcatggccgtggggatcgtgagcatcctgctctccagcctgctgaagaacgacgtccccctcgccggccccctgatcgccgggggcatgctgatcgcctgctacgtgatctccggcagctccgcggacctcagcctggagaaggccgccgaggtgtcctgggaggaggaggccgagcacagcggggcctcccacaacatcctggtcgaggtgcaggacgacggcaccatgaagatcaaggacgaggagcgggacgacaccctcaccatcctgctgaaggcgaccctcctggccgtgagcggggtctacccgctgtccatccccgccaccctcttcgtgtggtacttctggcagaagaagaagcagcgcagcggcgtgctgtgggacacccccagcccgcccgaggtcgagcgggccgtgctggacgacgggatctaccgcatcatgcagcggggcctgctcggccgcagccaggtgggggtcggcgtgttccaggagaacgtgttccacaccatgtggcacgtcacccgcggggcggtgctgatgtaccagggcaagcgcctggagccctcctgggcgagcgtgaagaaggacctcatctcctacgggggcggctggcggctgcaggggagctggaacacgggcgaggaggtccaggtgatcgccgtggagcccgggaagaaccccaagaacgtccagaccgcccccggcaccttcaagacccccgagggggaggtgggcgccatcgccctggacttcaagcccggcacgtccgggagccccatcgtgaaccgcgagggcaagatcgtcgggctctacggcaacggcgtggtgaccaccagcgggacctacgtctccgcgatcgcccaggccaaggccagccaggagggcccgctgcccgagatcgaggacgaggtgttccggaagcgcaacctgacgatcatggacctccaccccgggtccggcaagacccggcgctacctgccggcgatcgtgcgggaggccatcaagcgcaagctgcgcaccctcatcctggcccccacccgggtcgtggccagcgagatggccgaggcgctgaaggggatgcccatccgctaccagacgaccgccgtgaagtccgagcacaccggcaaggagatcgtcgacctcatgtgccacgccaccttcacgatgcggctgctgagccccgtgcgcgtgccgaactacaacatgatcatcatggacgaggcccacttcaccgacccctccagcatcgccgcgcggggctacatctccacccgcgtcgggatgggcgaggccgccgccatcttcatgaccgccacgccgcccgggagcgtggaggcgttcccgcagtccaacgccgtgatccaggacgaggagcgggacatccccgagcgcagctggaactccggctacgagtggatcaccgacttccccgggaagaccgtctggttcgtgcccagcatcaagtccggcaacgacatcgccaactgcctccggaagaacggcaagcgcgtgatccagctgagccggaagaccttcgacacggagtaccagaagaccaagaacaacgactgggactacgtcgtgaccaccgacatctccgagatgggggccaacttccgcgcggaccgggtgatcgacccgcgccggtgcctgaagcccgtcatcctcaaggacggccccgagcgcgtgatcctggccgggcccatgccggtcacggtggccagcgccgcccagcggcgcggccggatcgggcgcaaccacaacaaggagggcgaccagtacatctacatgggccagcccctgaacaacgacgaggaccacgcgcactggaccgaggccaagatgctcctggacaacatcaacacccccgaggggatcatccccgccctgttcgagccggagcgcgagaagtccgccgccatcgacggcgagtaccggctccgcggggaggcgcggaagaccttcgtggagctgatgcgccggggcgacctgcccgtctggctcagctacaaggtggccagcgaggggttccagtactccgaccgccggtggtgcttcgacggcgagcgcaacaaccaggtgctggaggagaacatggacgtcgagatctggacgaaggagggcgagcggaagaagctgcgcccccggtggctcgacgcccgcacctacagcgaccccctggccctgcgggagttcaaggagttcgccgcggggcgccggtccgtgagcggcgacctcatcctggagatcgggaagctgccgcagcacctcacccagcgcgcccagaacgccctggacaacctggtgatgctccacaactccgagcagggcggccgggcctaccgccacgcgatggaggagctgcccgacaccatcgagacgctgatgctcctggccctgatcgccgtcctcaccgggggcgtgaccctgttcttcctgagcgggcggggcctcgggaagacctccatcggcctgctgtgcgtgatggccagctccgtcctcctgtggatggccagcgtggagccccactggatcgcggcctccatcatcctggagttcttcctcatggtgctgctgatccccgagccggaccgccagcggacgccccaggacaaccagctcgcctacgtcgtgatcggcctgctgttcatgatcctcacggtggccgccaacgagatggggctgctggagaccaccaagaaggacctcggcatcgggcacgtcgcggtgggcaaccaccaccacgccgccatgctggacgtggacctgcaccccgccagcgcctggaccctctacgcggtcgccacgaccatcatcaccccgatgatgcgccacaccatcgagaacacgaccgccaacatctccctgaccgccatcgccaaccaggcggccatcctgatggggctcgacaagggctggcccatcagcaagatggacatcggcgtgcccctgctggccctcgggtgctactcccaggtgaaccccctgaccctgacggccgcggtcctcatgctggtggcccactacgccatcatcggcccggggctgcaggccaaggccacccgcgaggcgcagaagcggaccgccgccggcatcatgaagaaccccaccgtggacgggatcgtcgccatcgacctcgaccccgtggtgtacgacgccaagttcgagaagcagctgggccagatcatgctgctcatcctgtgcacgagccagatcctgctcatgcgcaccacctgggcgctgtgcgagtccatcaccctggccacgggccccctcaccaccctgtgggaggggagcccgggcaagttctggaacaccacgatcgccgtctccatggccaacatcttccgggggagctacctggccggcgcgggcctcgccttcagcctgatgaagtccctcgggggcgggcgccgggggaccggggcccagggcgagaccctcggcgagaagtggaagcgccagctgaaccagctgagcaagtccgagttcaacacctacaagcggagcgggatcatggaggtggaccgctccgaggccaaggagggcctcaagcgcggggagacgaccaagcacgcggtgagccgcggcaccgccaagctgcggtggttcgtcgagcgcaacctggtgaagcccgaggggaaggtgatcgacctgggctgcggccgcggcgggtggtcctactactgcgccgggctcaagaaggtcaccgaggtgaaggggtacacgaagggcgggcccggccacgaggagcccatcccgatggccacctacgggtggaacctggtgaagctgcacagcggcaaggacgtcttcttcatcccgcccgagaagtgcgacaccctcctgtgcgacatcggggagtccagccccaacccgaccatcgaggagggccgcacgctgcgggtgctcaagatggtggagccctggctgcgcgggaaccagttctgcatcaagatcctgaacccctacatgccctccgtcgtggagaccctcgagcagatgcagcggaagcacggcggcatgctggtgcgcaacccgctgagccggaactccacccacgagatgtactgggtcagctgcgggaccggcaacatcgtgtccgccgtgaacatgaccagccgcatgctcctgaaccgcttcacgatggcgcaccggaagcccacctacgagcgcgacgtcgacctgggggccggcacccggcacgtggccgtggagcccgaggtcgccaacctcgacatcatcggccagcgcatcgagaacatcaagcacgagcacaagtccacctggcactacgacgaggacaacccctacaagacgtgggcctaccacgggagctacgaggtgaagccgtccggcagcgcgagctccatggtcaacggggtggtgaagctgctgaccaagccctgggacgtcatccccatggtgacccagatcgccatgaccgacacgacccccttcggccagcagcgggtgttcaaggagaaggtcgacacccgcaccccgaaggccaagcgggggacggcccagatcatggaggtgaccgccaagtggctctggggcttcctgagccgcaacaagaagccccggatctgcacccgcgaggagttcacccggaaggtgcgctccaacgcggccatcggcgccgtcttcgtggacgagaaccagtggaacagcgccaaggaggcggtggaggacgagcggttctgggacctggtccaccgcgagcgggagctccacaagcaggggaagtgcgccacgtgcgtgtacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtggagggcgaggggctccacaagctgggctacatcctgcgcgacatctccaagatccccgggggcaacatgtacgccgacgacaccgccggctgggacacccggatcaccgaggacgacctccagaacgaggcccgcatcacggacatcatggagccggagcacgccctgctggccaagagcatcttcaagctcacctaccagaacaaggtcgtgcgcgtgcagcggcccgccaagaacgggaccgtcatggacgtgatctcccgccgggaccagcgcggcagcggccaggtgggcacctacggcctgaacacgttcaccaacatggaggcccagctgatccggcagatggagtccgaggggatcttcagcccctccgagctcgagacccccaacctggccgagcgcgtcctggactggctcgagaagtacggcgtggagcggctgaagcgcatggccatcagcggggacgactgcgtggtcaagccgatcgacgaccggttcgcgaccgccctgacggccctcaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctggtgggccgggcccgcgtcagccagggggccggctggtccctccgggagaccgcgtgcctgggcaagagctacgcccagatgtggcagctgatgtacttccaccgccgggacctccgcctggccgccaacgcgatctgctccgccgtgcccgtggactggatccccaccagccggaccacgtggtccatccacgcccaccaccagtggatgaccaccgaggacatgctgagcgtctggaaccgcgtgtggatcgaggagaacccctggatggaggacaagacccacatctccagctggggcgacgtgccgtacctcgggaagcgcgaggaccagtggtgcggctccctgatcggcctgacggcccgggccacctgggcgaccaacatccaggtcgccatcaaccaggtgcgccggctcatcgggaacgagaactacctggactacatgaccagcatgaagcgcttcaagaacgagtccgaccccgagggcgccctgtggtga

SEQ ID NO: 8054 - RNA, 9879 nt, synthetic construct
  misc_feature 1..9879: note = derived and/or modified CDS sequence (opt1) from DENV-1__JF937651__SS-prME
  source 1..9879: mol_type = other RNA
agcgtgaccatgctgctcatgctgatgcccaccgccctggccttccacctcaccacccggggcggggagccccacatgatcctgtccaagcaggagcggggcaagagcctcctgttcaagacctccgcgggggtgaacatgtgcaccctgatcgccatggacctgggggagctctgcgaggacaccatgacctacaagtgcccccggatcaccgaggccgagcccgacgacgtggactgctggtgcaacgccaccgacacgtgggtgacctacgggacctgcagccagaccggggagcaccggcgcgacaagcggtccgtcgccctggcgccccacgtgggcctggggctcgagacgcgcaccgagacctggatgagctccgagggcgcctggaagcagatccagcgggtggagacctgggccctgcgccaccccgggttcacggtcatcgccctgttcctcgcgcacgccatcggcaccagcatcacccagaaggggatcatcttcatcctgctgatgctcgtgaccccctccatggccatgcggtgcgtgggcatcggcagccgcgacttcgtcgaggggctgtccggcgccacgtgggtggacgtggtcctggagcacgggagctgcgtgaccaccatggccaaggacaagcccaccctcgacatcgagctgctgaagacggaggtgaccaaccccgcgatcctccggaagctgtgcatcgaggccaagatctccaacaccaccacggacagccgctgcccgacccagggcgaggccaccctggtcgaggagcaggacgccaacttcgtgtgccggcgcaccttcgtggaccggggctgggggaacggctgcggcctgttcggcaaggggtccctgatcacgtgcgccaagttcaagtgcgtcaccaagctggagggcaagatcgtgcagtacgagaacctcaagtacagcgtgatcgtcaccgtgcacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtcaccttcaagaccgcccacgcgaagaagcaggaggtggtggtcctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtgatgtgcaccgggtccttcaagctggagaaggaggtggcggagacgcagcacggcaccgtcctggtgcagatcaagtacgagggcaccgacgccccctgcaagatccccttcagcacccaggacgagaagggggtgacgcagaacggccggctgatcaccgccaacccgatcgtcaccgacaaggagaagcccgtgaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtcttcaccagcgtggggaagctcatccaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctccgggacagctacacccaggtgtgcgaccaccgcctgatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtcgtggacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcaccctggccgtgttcctcctgctgatcatggggcagctcacgtggaacgacctgatccgcctgtgcatcatggtcggcgcgaacgcctgcgaccgcatggggatgggcaccacctacctcgccctgatggccaccttcaagatgcggccgatgttcgccgtgggcctcctgttccgccggctgacgagccgcgaggtgctgctcctgaccatcgggctgtccctcgtcgcgagcgtggagctgcccaactccctggaggagctcggcgacgggctggccatgggcatcatgatcctgaagctcctgaccgacttccagagctaccagctgtgggccaccctcctgtccctgacgttcatcaagaccaccttcagcctccactacgcctggaagaccatggcgatggtgctgtccatcgtcagcctgttccccctctgcctgtccacgaccagccagaagaccacctggctgcccgtgctcctgggctccctggggtgcaagccgctcacgatgttcctgatcgccgagaacaagatctggggccggcgcagctggcccctgaacgaggggatcatggccgtcggcatcgtgtccatcctcctgagcagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctggacgacggcatctaccgcatcatgcagcggggcctcctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacccccgagggcgaggtcggcgccatcgcgctcgacttcaagcccgggacgtccggcagccccatcgtgaaccgcgaggggaagatcgtgggcctgtacggcaacggggtcgtgaccacctccggcacctacgtgagcgccatcgcccaggccaaggcgagccaggaggggccgctgcccgagatcgaggacgaggtcttccggaagcgcaacctcacgatcatggacctgcaccccggctccgggaagacccggcgctacctgccggccatcgtgcgggaggccatcaagcgcaagctccgcaccctgatcctggcccccacccgggtggtcgccagcgagatggcggaggccctcaagggcatgcccatccgctaccagacgaccgccgtgaagtccgagcacaccggcaaggagatcgtggacctgatgtgccacgccaccttcacgatgcggctgctcagccccgtccgcgtgccgaactacaacatgatcatcatggacgaggcccacttcaccgacccctccagcatcgcggcccgggggtacatctccacccgcgtgggcatgggggaggccgccgccatcttcatgaccgcgacgccgcccggcagcgtcgaggccttcccgcagtccaacgccgtgatccaggacgaggagcgggacatccccgagcgcagctggaactccgggtacgagtggatcaccgacttccccggcaagaccgtgtggttcgtccccagcatcaagtccggcaacgacatcgccaactgcctgcggaagaacgggaagcgcgtgatccagctgagccggaagaccttcgacacggagtaccagaagaccaagaacaacgactgggactacgtggtcaccaccgacatctccgagatgggcgcgaacttccgcgccgaccgggtgatcgacccgcgccggtgcctcaagcccgtgatcctgaaggacgggcccgagcgcgtcatcctggccggccccatgccggtgacggtggccagcgccgcgcagcggcgcgggcggatcggccgcaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgccgcgatcgacggggagtaccggctgcgcggcgaggcccggaagaccttcgtcgagctgatgcgccgcggggacctccccgtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctacagcgaccccctggccctccgggagttcaaggagttcgcggccggccgccggtccgtcagcggggacctgatcctggagatcggcaagctcccgcagcacctgacccagcgcgcccagaacgccctggacaacctcgtgatgctgcacaactccgagcagggcgggcgggcgtaccgccacgccatggaggagctgcccgacaccatcgagacgctcatgctgctggccctcatcgccgtgctgaccggcggggtcaccctgttcttcctcagcggccgggggctgggcaagacctccatcggcctgctctgcgtgatggccagctccgtgctgctgtggatggcgagcgtcgagccccactggatcgccgcctccatcatcctcgagttcttcctgatggtgctgctcatccccgagccggaccgccagcggacgccccaggacaaccagctggcctacgtggtcatcgggctcctcttcatgatcctgacggtggccgcgaacgagatgggcctgctcgagaccaccaagaaggacctggggatcggccacgtggccgtcgggaaccaccaccacgccgccatgctggacgtggacctccaccccgccagcgcgtggaccctgtacgccgtggccacgaccatcatcaccccgatgatgaagcacaccatcgagaacacgaccgccaacatctccctgaccgccatcgcgaaccaggccgccatcctcatgggcctggacaagggctggcccatcagcaagatggacatcggggtccccctgctcgccctgggctgctactcccaggtgaaccccctgaccctcacggcggccgtgctgatgctggtcgcccactacgccatcatcgggccgggcctccaggccaaggcgacccgcgaggcccagaagcgcaccgccgccgggatcatgaagaaccccaccgtggacggcatcgtggccatcgacctggaccccgtcgtgtacgacgcgaagttcgagaagcagctgggccagatcatgctcctgatcctgtgcacgagccagatcctcctgatgcggaccacctgggccctgtgcgagtccatcaccctcgccacggggcccctgaccaccctgtgggagggcagcccggggaagttctggaacaccacgatcgccgtgtccatggccaacatcttccgcggcagctacctcgcgggcgccgggctggccttctccctgatgaagtccctcggcgggggccggcgcgggaccggcgcccagggcgagaccctgggggagaagtggaagcggcagctgaaccagctcagcaagtccgagttcaacacctacaagcgcagcggcatcatggaggtcgaccggtccgaggcgaaggaggggctgaagcgcggcgagacgaccaagcacgccgtgagccgggggaccgccaagctgcgctggttcgtggagcggaacctggtcaagcccgagggcaaggtgatcgacctcggctgcgggcgcggcgggtggtcctactactgcgccggcctgaagaaggtgaccgaggtcaaggggtacacgaagggcggccccgggcacgaggagcccatcccgatggccacctacggctggaacctggtgaagctccacagcgggaaggacgtgttcttcatcccgcccgagaagtgcgacaccctgctgtgcgacatcggcgagtccagccccaacccgaccatcgaggaggggcggacgctccgcgtcctgaagatggtggagccctggctgcggggcaaccagttctgcatcaagatcctcaacccctacatgccctccgtggtcgagaccctggagcagatgcagcgcaagcacggcgggatgctggtgcggaacccgctcagccgcaactccacccacgagatgtactgggtgagctgcggcaccgggaacatcgtctccgcggtgaacatgaccagccggatgctgctgaaccgcttcacgatggcccaccgcaagcccacctacgagcgggacgtggacctcggcgccggcacccgccacgtcgccgtggagcccgaggtggccaacctggacatcatcgggcagcggatcgagaacatcaagcacgagcacaagtccacctggcactacgacgaggacaacccctacaagacgtgggcgtaccacggcagctacgaggtcaagccgtccgggagcgcctccagcatggtgaacggcgtggtcaagctgctcaccaagccctgggacgtgatccccatggtcacccagatcgccatgaccgacacgacccccttcgggcagcagcgcgtgttcaaggagaaggtggacacccggaccccgaaggccaagcgcggcacggcccagatcatggaggtcaccgcgaagtggctgtggggcttcctgagccggaacaagaagccccgcatctgcacccgggaggagttcaccgggaaggtgcgctccaacgccgccatcggcgccgtgttcgtcgacgagaaccagtggaacagcgcgaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaagggctcccgggccatctggtacatgtggctcggggcgcgcttcctggagttcgaggccctgggcttcatgaacgaggaccactggttcagccgggagaactccctcagcggggtggagggcgaggggctgcacaagctgggctacatcctccgcgacatctccaagatccccggcgggaacatgtacgccgacgacaccgccggctgggacacccggatcaccgaggacgacctgcagaacgaggcccgcatcacggacatcatggagccggagcacgcgctgctcgccaagagcatcttcaagctgacctaccagaacaaggtggtccgggtgcagcgccccgccaagaacgggaccgtgatggacgtcatctcccgccgggaccagcgcggcagcggccaggtggggacctacggcctgaacacgttcaccaacatggaggcccagctcatccggcagatggagtccgaggggatcttcagcccctccgagctggagacccccaacctggccgagcgcgtgctcgactggctggagaagtacggcgtcgagcggctgaagcgcatggcgatcagcggggacgactgcgtggtgaagccgatcgacgaccggttcgccaccgccctcacggccctgaacgacatgggcaaggtccgcaaggacatcccccagtgggagccctccaagggctggaacgactggcagcaggtccccttctgcagccaccacttccaccagctgatcatgaaggacgggcgggagatcgtggtcccgtgccgcaaccaggacgagctcgtgggccgggcccgcgtgtcccagggggcgggctggagcctgcgggagaccgcctgcctgggcaagagctacgcccagatgtggcagctcatgtacttccaccgccgggacctgcgcctggccgcgaacgccatctgctccgccgtccccgtggactggatccccaccagccggaccacgtggtccatccacgcccaccaccagtggatgaccaccgaggacatgctcagcgtgtggaaccgcgtctggatcgaggagaacccctggatggaggacaagacccacatctccagctggggcgacgtgccgtacctgggcaagcgggaggaccagtggtgcgggtccctgatcggcctcacggcccgcgcgacctgggccaccaacatccaggtggccatcaaccaggtccgccggctgatcgggaacgagaactacctggactacatgaccagcatgaagcgcttcaagaacgagtccgaccccaagggcgccctctggtga

SEQ ID NO: 8055 - RNA, 9879 nt, synthetic construct
  misc_feature 1..9879: note = derived and/or modified CDS sequence (opt1) from DENV-1__GU131956__SS-prME
  source 1..9879: mol_type = other RNA
agcgtgaccatgctgctcatgctgctgcccaccgccctcgccttccacctgacgacccggggcggggagccccacatgatcgtgagcaagcaggagcggggcaagagcctcctgttcaagaccagcgcgggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtgacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggaccatcttcatcctgctgatgctcgtgacgccctccatggccatgcgctgcgtcggcatcggcaaccgggacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgcgatcctccgcaagctgtgcatcgaggccaagatcagcaacaccacgaccgactcccggtgccccacccagggcgaggccaccctggtggaggagcaggacgccaacttcgtgtgccgccggacgttcgtcgaccgcggctgggggaacggctgcggcctcttcggcaaggggagcctgctgacctgcgccaagttcaagtgcgtgaccaagctcgagggcaagatcgtgcagtacgagaacctgaagtactccgtcatcgtgaccgtgcacacgggcgaccagcaccaggtcgggaacgagaccaccgagcacggcaccatcgcgaccatcacgccccaggcccccaccagcgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggacctccggggccagcaccagccaggagacgtggaaccgccaggacctcctggtgaccttcaagaccgcccacgcgaagaagcaggaggtggtcgtgctgggctcccaggagggcgccatgcacaccgccctcacgggggccaccgagatccagaccagcggcaccacgaccatcttcgccgggcacctgaagtgccggctgaagatggacaagctcaccctgaagggcacctcctacgtgatgtgcacggggagcttcaagctggagaaggaggtcgcggagacccagcacggcaccgtgctggtgcaggtcaagtacgagggcaccgacgccccctgcaagatccccttctccacgcaggacgagaagggggtgacccagaacggccgcctcatcaccgccaacccgatcgtgaccgacaaggagaagcccgtcaacatcgagacggagccgcccttcggggagagctacatcgtggtgggcgccggcgagaaggcgctgaagctgtcctggttcaagaaggggagctccatcggcaagatgttcgaggccaccgcccgcggggcccgccggatggccatcctcggcgacaccgcgtgggacttcgggagcatcggcggcgtcttcacctccgtggggaagctggtgcaccaggtcttcggcacggcctacggggtgctgttcagcggcgtgtcctggaccatgaagatcgggatcggcatcctcctgacctggctgggcctcaacagccgctccaccagcctgtccatgacgtgcatcgccgtcgggatggtgaccctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacgcggctcgagaacatcatgtggaagcagatcagcaacgagctgaaccacatcctgctcgagaacgacatgaagttcaccgtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacacgccggagtgccccgacaaccagcgggcctggaacatctgggaggtggaggactacggcttcgggatcttcaccaccaacatctggctgaagctccgcgactcctacacccagatgtgcgaccaccggctgatgagcgcggccatcaaggactccaaggccgtccacgccgacatgggctactggatcgagagcgagaagaacgagacgtggaagctggcccgcgcgtccttcatcgaggtgaagacctgcacctggcccaagagccacaccctctggtccaacggcgtgctggagagcgagatgatcatccccaagatctacgggggcccgatctcccagcacaactaccggcccgggtacttcacgcagaccgccggcccctggcacctggggaagctcgagctggacttcgacctgtgcgagggcaccaccgtcgtggtggacgagcactgcggcaaccgcgggccgagcctccggacgaccaccgtcaccggcaagatcatccacgagtggtgctgccgctcctgcacgctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgaccggcaccctggccgtcttcctgctcctggtgatggggcagctgacctggaacgacctcatccgcctgtgcatcatggtgggcgcgaacgcctccgaccgcatggggatgggcacgacctacctggccctcatggccaccttcaagatgcggccgatgttcgccgtcggcctgctgttccgccggctcaccagccgcgaggtgctgctgctcacgatcgggctgtccctggtggcgagcgtcgagctccccaactccctggaggagctgggcgacgggctcgccatgggcatcatgatgctgaagctgctcaccgagttccagccccaccagctgtggaccaccctgctcagcctgacgttcatcaagaccaccctgtccctcgactacgcctggaagaccacggccatggcgctgagcatcgtgtccctgttccccctctgcctgagcaccacctcccagaagaccacctggctgccggtcctcctgggcagcttcgggtgcaagcccctgacgatgttcctcatcaccgagaacaagatctggggccggaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggtccagcgcggacctctccctggagaaggccgccgaggtgagctgggagcaggaggccgagcactccggcaccagccacaacatcctggtggaggtccaggacgacgggaccatgaagatcaaggacgaggagcgcgacgacacgctcaccatcctgctgaaggccaccctcctggcggtgtccggcgtgtaccccatgagcatccccgccaccctgttcgtctggtacttctggcagaagaagaagcagcggtccggggtgctctgggacacgcccagcccgcccgaggtggagcgcgccgtcctggacgacggcatctaccggatcctgcagcgcggcctgctcgggcggtcccaggtgggcgtgggggtcttccaggacggcgtgttccacaccatgtggcacgtgacccgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgcggtggagcccgggaagaacccgaagaacgtgcagacgacccccggcaccttcaagacccccgagggcgaggtcggggccatcgccctggacttcaagcccggcacgagcgggtccccgatcgtgaaccgggagggcaagatcgtgggcctgtacgggaacggcgtcgtgaccaccagcgggacctacgtgtccgccatcgcccaggcgaaggccagccaggagggccccctccccgagatcgaggacgaggtcttcaagaagcgcaacctgacgatcatggacctgcacccggggagcggcaagacccggcgctacctccccgccatggtgcgggaggccatcaagcgcaagctgcggaccctgatcctcgcgcccacccgcgtggtcgcctccgagatggccgaggccctgaagggcatgcccatccgctaccagacgaccgccgtcaagagcgagcacaccgggcgggagatcgtggacctgatgtgccacgcgaccttcacgatgcgcctcctgtccccggtccgggtgcccaactacaacatgatcatcatggacgaggcccacttcaccgaccccgccagcatcgccgcccgcggctacatctccacccgggtggggatgggcgaggcggccgccatcttcatgaccgccacgcccccggggagcgtcgaggccttcccccagtccaacgcggtgatccaggacgaggagcgcgacatccccgagcggagctggaactccggctacgactggatcaccgacttccccggcaagaccgtgtggttcgtcccgagcatcaagtccgggaacgacatcgccaactgcctgcgcaagaacggcaagcgggtgatccagctcagccgcaagaccttcgacacggagtaccagaagaccaagaacaacgactgggactacgtggtcaccaccgacatctccgagatgggggccaacttccgggccgaccgcgtgatcgacccccggcgctgcctgaagcccgtgatcctgaaggacggccccgagcgggtcatcctcgcggggccgatgcccgtgacggtggccagcgccgcccagcgccggggccgcatcggccggaaccagaacaaggagggggaccagtacgtctacatgggccagcccctgaacaacgacgaggaccacgcccactggaccgaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcgtccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcccggacgtactccgacccgctcgccctgcgcgagttcaaggagttcgccgccgggcggcgcagcgtgagcggcgacctgatcctcgagatcggcaagctgccccagcacctgaccctccgggcgcagaacgccctggacaacctggtgatgctccacaactccgagcagggcgggaaggcctaccgccacgccatggaggagctgcccgacaccatcgagaccctgatgctcctggcgctgatcgccgtcctcaccggcggggtgaccctgttcttcctgagcgggaaggggctcggcaagacctccatcgggctgctgtgcgtgaccgccagctccgccctcctgtggatggccagcgtcgagccccactggatcgcggcctccatcatcctggagttcttcctcatggtgctgctgatcccggagcccgaccggcagcgcacgccccaggacaaccagctcgcctacgtggtcatcggcctgctgttcatgatcctcaccgtggccgccaacgagatggggctgctggagaccaccaagaaggacctcggcatcgggcacgtggcggccgagaaccaccagcacgccacgatgctggacgtcgacctgcggccggccagcgcctggaccctctacgcggtggccaccaccgtgatcacgcccatgatgcgccacaccatcgagaacaccaccgccaacatctccctgacggccatcgccaaccaggcggccatcctgatgggcctcgacaagggctggcccatcagcaagatggacatcggggtccccctgctggccctcggctgctactcccaggtgaacccgctgaccctgaccgccgcggtgctcatgctggtcgcccactacgccatcatcgggcccggcctgcaggccaaggccacccgggaggcgcagaagcgcacggccgccgggatcatgaagaaccccaccgtggacggcatcgtggccatcgacctcgaccccgtcgtgtacgacgccaagttcgagaagcagctgggccagatcatgctgctcatcctgtgcaccagccagatcctgctcatgcgcaccacgtgggcgctgtgcgagtccatcaccctggccaccgggccgctcaccacgctgtgggagggcagccccgggaagttctggaacaccaccatcgccgtgtccatggccaacatcttccggggcagctacctggccggcgcggggctcgccttctccctgatgaagtccctgggcgggggccgccgggggaccggcgcccagggcgagacgctcggggagaagtggaagcgccagctgaaccagctgtccaagagcgagttcaacacctacaagcggagcggcatcatggaggtcgaccgctccgaggccaaggaggggctcaagcggggcgagaccaccaagcacgcggtgagccgcgggaccgccaagctgcggtggttcgtggagcgcaacctggtcaagcccgagggcaaggtgatcgacctgggctgcgggcggggcgggtggtcctactactgcgccggcctcaagaaggtgacggaggtcaaggggtacaccaagggcggccccgggcacgaggagccgatccccatggccacctacggctggaacctggtgaagctgcacagcgggaaggacgtgttcttcatgccgcccgagaagtgcgacaccctcctgtgcgacatcggcgagtccagcccgaaccccacgatcgaggaggggcgcaccctgcgggtcctcaagatggtggagccctggctgcgcggcaaccagttctgcatcaagatcctgaacccctacatgccgtccgtggtcgagaccctcgagcagatgcagcggaagcacggcgggatgctggtgcgcaaccccctgagccggaactccacccacgagatgtactgggtgagctgcggcacggggaacatcgtctccgccgtgaacatgaccagccgcatgctcctgaaccggttcaccatggcgcaccgcaagcccacctacgagcgcgacgtggacctgggcgccggcacgcggcacgtcgccgtggagcccgaggtggccaacctcgacatcatcgggcagcgcatcgagaacatcaagaacgagcacaagtccacctggcactacgacgaggacaacccgtacaagacctgggcctaccacggcagctacgaggtcaagccctccgggagcgcgtccagcatggtgaacggcgtggtccggctgctgaccaagccctgggacgtgatccccatggtcacgcagatcgccatgaccgacaccaccccgttcgggcagcagcgcgtgttcaaggagaaggtggacacgcggacgccccgggccaagcggggcaccacccagatcatggaggtcacggccaagtggctctggggcttcctgtcccgcaacaagaagccccggatctgcacccgcgaggagttcacccggaaggtgcgcagcaacgccgcgatcggggccgtgttcgtcgacgagaaccagtggaacagcgccaaggaggccgtggaggacgagcggttctgggacctggtgcaccgcgagcgggagctccacaagcagggcaagtgcgcgacctgcgtctacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacacggccgggtgggacacccggatcaccgaggacgacctccagaacgaggccaagatcaccgagatcatggagcccgagcacgccctgctggccacgagcatcttcaagctcacctaccagaacaaggtggtccgcgtgcagcgccccgcgaagaacggcaccgtgatggacgtcatctcccggcgcgaccagcgggggagcggccaggtgggcacctacgggctgaacacgttcaccaacatggaggtgcagctgatccgccagatggagtccgagggcatcttcctccccagcgagctggagaccccgaacctggccgagcgggtcctcgactggctggagaagcacggggccgagcgcctgaagcggatggccatctccggcgacgactgcgtggtgaagcccatcgacgaccgcttcgccaccgcgctcaccgccctgaacgacatggggaaggtccggaaggacatcccccagtgggagcccagcaagggctggaacgactggcagcaggtcccgttctgctcccaccacttccaccagctgatcatgaaggacggccgcgagatcgtggtcccctgccggaaccaggacgagctcgtggggcgcgcccgggtgagccagggcgccgggtggtccctgcgcgagacggcctgcctgggcaagagctacgcgcagatgtggcagctcatgtacttccaccggcgcgacctgcggctggccgccaacgccatctgctccgcggtccccgtggactgggtgcccaccagccgcaccacctggagcatccacgcccaccaccagtggatgacgaccgaggacatgctctccgtctggaaccgggtgtggatcgaggagaacccgtggatggaggacaagacccacgtgagctcctgggaggaggtcccctacctggggaagcgcgaggaccagtggtgcggcagcctgatcggcctcaccgcccgcgccacgtgggccaccaacatccaggtggcgatcaaccaggtgcggcgcctgatcgggaacgagaactacctggactacatgacctccatgaagcggttcaagaacgagagcgaccccgagggcgccctctggtga

SEQ ID NO: 8056 - RNA, 9879 nt, synthetic construct
  misc_feature 1..9879: note = derived and/or modified CDS sequence (opt1) from DENV-1__GU131958__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgcggtcagccgcgggaccgccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacacgaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccaccatcgaggaggggcgcacgctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacccacgagatgtactgggtgagctgcggcaccgggaacatcgtgtccgccgtcaacatgacgagccgcatgctcctgaaccggttcaccatggcgcaccgcaagcccaccttcgagcgcgacgtggacctgggcgccggcacccggcacgtggccgtcgagcccgaggtggccaacctcgacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtcaacggcgtggtgcggctgctgaccaagccctgggacgtcatccccatggtgacccagatcgccatgacggacaccaccccgttcgggcagcagcgcgtcttcaaggagaaggtggacacccggacgccccgcgccaagcggggcaccacccagatcatggaggtgaccgccaagtggctctggggcttcctgtcccgcaacaagaagccccggatctgcacgcgcgaggagttcacccggaaggtccgcagcaacgccgcgatcggggccgtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgcggacgacaccgccgggtgggacacgcggatcaccgaggacgacctccagaacgaggccaagatcaccgacatcatggagcccgagcacgccctgctggccaccagcatcttcaagctcacgtaccagaacaaggtggtgcgcgtccagcgccccgcgaagaacggcaccgtgatggacgtgatctcccggcgcgaccagcgggggagcggccaggtcggcacctacgggctgaacaccttcacgaacatggaggtgcagctgatccgccagatggagtccgagggcatcttcctccccagcgagctggagaccccgaacctggccgagcgggtgctcgactggctggagaagcacggggccgagcgcctgaagcggatggccatctccggcgacgactgcgtcgtgaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgctccgcggtgcccgtcgactgggtgcccacgagccgcaccacctggagcatccacgcccaccaccagtggatgaccacggaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcaccgcccgcgccacctgggccacgaacatccaggtcgcgatcaaccaggtgcggcgcctgatcgggaacgagaactacctggactacatgacctccatgaagcggttcaagaacgagagcgaccccgagggcgccctctggtga

SEQ ID NO: 8057 - RNA, 9879 nt, synthetic construct
  misc_feature 1..9879: note = derived and/or modified CDS sequence (opt1) from DENV-1__GQ868499__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcggccaccgccgggagaagcgctccgtggccctggcgccccacgtggggctgggcctcgagacgcggaccgagacctggatgagctccgagggggcctggaagcagatccagcgggtcgagacctgggccctgcggcaccccggcttcacggtgatcgccctgttcctcgcgcacgccatcgggaccagcatcacccagaagggcatcatcttcatcctgctgatgctcgtgaccccctccatggccatgcgctgcgtcggcatcgggaaccgggacttcgtggagggcctgagcggggccacgtgggtggacgtcgtgctggagcacggctcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcgggtggggcaacgggtgcggcctcttcgggaagggcagcctgctgacgtgcgccaagttcaagtgcgtgaccaagctcgagggcaagatcgtccagtacgagaacctgaagtactccgtgatcgtgaccgtccacaccggggaccagcaccaggtgggcaacgagacgaccgagcacgggaccatcgcgaccatcacgccccaggcccccacgagcgagatccagctgaccgactacggcgccctcaccctggactgcagcccccggaccgggctggacttcaacgagatggtcctcctgacgatgaaggagaagtcctggctggtgcacaagcagtggttcctcgacctgccgctgccctggacctccggcgccagcaccagccaggagacctggaaccgccaggacctcctggtgacgttcaagaccgcccacgcgaagaagcaggaggtcgtggtgctgggctcccaggagggggccatgcacaccgccctcaccggcgccacggagatccagaccagcgggaccaccacgatcttcgccggccacctgaagtgccggctgaagatggacaagctcaccctgaaggggacctcctacgtcatgtgcaccggcagcttcaagctggagaaggaggtggcggagacgcagcacggcaccgtgctggtccaggtgaagtacgaggggaccgacgccccctgcaagatccccttctccacccaggacgagaagggcgtgacgcagaacgggcgcctcatcaccgccaacccgatcgtcaccgacaaggagaagcccgtgaacatcgagaccgagccgcccttcggcgagagctacatcgtggtcggcgccggggagaaggcgctgaagctgtcctggttcaagaagggcagctccatcgggaagatgttcgaggccacggcccggggcgcccgccggatggccatcctcggggacaccgcgtgggacttcggcagcatcggcggggtgttcacctccgtgggcaagctggtccaccaggtgttcgggaccgcctacggcgtgctgttcagcggggtctcctggacgatgaagatcggcatcggcatcctcctgacctggctggggctcaacagccgctccaccagcctgtccatgacctgcatcgccgtgggcatggtgacgctgtacctcggggtcatggtgcaggccgacagcggctgcgtgatcaactggaaggggcgcgagctgaagtgcggctccggcatcttcgtcaccaacgaggtgcacacctggaccgagcagtacaagttccaggccgacagcccgaagcggctgagcgcggccatcgggaaggcctgggaggagggcgtgtgcgggatccgctccgccacccggctcgagaacatcatgtggaagcagatcagcaacgagctgaaccacatcctgctcgagaacgacatgaagttcacggtcgtggtgggcgacgccaacgggatcctggcgcagggcaagaagatgatccgcccccagcccatggagcacaagtactcctggaagtcctggggcaaggccaagatcatcggggccgacatccagaacaccaccttcatcatcgacggccccgacaccccggagtgccccgacaaccagcgggcctggaacatctgggaggtcgaggactacgggttcggcatcttcacgaccaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtgaagacgtgcacctggcccaagagccacaccctctggtccaacggggtcctggagagcgagatgatcatccccaagatctacggcgggccgatctcccagcacaactaccggcccggctacttcacccagacggccgggccctggcacctgggcaagctcgagctggacttcgacctgtgcgagggcaccaccgtggtggtcgacgagcactgcgggaaccgcggcccgagcctccggaccacgaccgtgaccgggaagatcatccacgagtggtgctgccgctcctgcaccctgccgcccctgcggttccgcggcgaggacgggtgctggtacggcatggagatccggcccgtgaaggagaaggaggagaacctcgtccgcagcatggtgtccgccggcagcggggaggtggacagcttctccctgggcatcctgtgcgccagcatcatgatcgaggaggtcatgcggtcccgctggagccggaagatgctcatgacggggaccctggccgtgttcctgctcctgatcatgggccagctgacctggaaggacctcatccgcctgtgcatcatggtgggggcgaacgcctccgaccgcatgggcatgggcaccacgtacctggccctcatggccaccttcaagatgcggccgatgttcgccgtcgggctgctgttccgccggctcaccagccgcgaggtgctgctgctcaccatcggcctgtccctggtggcgagcctcgagctgcccaactccctggaggagctcggggacggcctggccatgggcatcatgatgctgaagctcctgacggagttccagccccaccagctgtggaccaccctcctgagcctgaccttcatcaagacgaccctctccctggactacgcctggaagaccaccgccatggcgctgagcatcgtctccctcttccccctgtgcctgagcacgacctcccagaagaccacctggctcccggtgctgctggggagcttcggctgcaagcccctcaccatgttcctgatcacggagaacaagatctgggggcggaagtcctggcccctgaacgagggcatcatggccatcgggatcgtcagcatcctcctgtccagcctgctcaagaacgacgtgcccctggccggcccgctgatcgccggcgggatgctcatcgcctgctacgtgatcagcggctccagcgcggacctgtccctggagaaggtcgccgaggtgagctgggagcaggaggccgagcactccgggaccagccacaacatcctcgtggaggtccaggacgacggcaccatgaagatcaaggacgaggagcgcgacgacaccctgacgatcctgctcaaggccaccctgctggccgtgtccggggtgtaccccatgagcatccccgcgaccctcttcgtctggtacttctggcagaagaagaagcagcggtccggcgtgctgtgggacacccccagcccgcccgaggtggagcgcgccgtcctggacgacggcatctaccggatcctgcagcgcgggctcctgggccggtcccaggtgggggtgggcgtcttccaggacggggtgttccacacgatgtggcacgtgacccgcggcgccgtcctgatgtaccagggcaagcggctcgagcccagctgggcctccgtgaagaaggacctgatcagctacgggggcgggtggcgcttccagggctcctggaacaccggggaggaggtgcaggtcatcgccgtggagcccggcaagaacccgaagaacgtgcagaccacgcccggcaccttcaagacccccgagggggaggtcggcgcgatcgccctggacttcaagcccgggaccagcggctccccgatcgtgaaccgggagggcaagatcgtggggctctacggcaacggggtcgtgacgaccagcggcacctacgtgtccgccatcgcccaggccaaggcgagccaggaggggcccctgcccgagatcgaggacgaggtcttcaagaagcgcaacctgaccatcatggacctccacccgggcagcggcaagacgcggcgctacctgcccgccatcgtgcgggaggccatcaagcgcaagctgcggaccctcatcctggcccccacccgcgtggtcgcgtccgagatggccgaggccctgaaggggatgcccatccgctaccagaccacggccgtcaagagcgagcacaccggccgggagatcgtggacctcatgtgccacgccaccttcaccatgcgcctgctgtccccggtccgggtgcccaactacaacatgatcatcatggacgaggcgcacttcacggaccccgccagcatcgccgcccgcgggtacatctccacccgggtgggcatgggggaggccgcggccatcttcatgaccgccacgccgcccggcagcgtcgaggccttcccccagtccaacgccgtgatccaggacgaggagcgcgacatccccgagcggagctggaactccggctacgactggatcacggacttccccgggaagaccgtgtggttcgtccccagcatcaagtccggcaacgacatcgcgaactgcctccgcaagaacgggaagcgggtgatccagctgagccgcaagaccttcgacaccgagtaccagaagacgaagaacaacgactgggactacgtggtcaccaccgacatctccgagatgggcgccaacttccgggccgaccgcgtgatcgacccccggcgctgcctgaagcccgtgatcctcaaggacgggcccgagcgggtcatcctggccggcccgatgcccgtgaccgtggcgagcgccgcccagcgccggggccgcatcgggcggaaccagaacaaggagggcgaccagtacgtctacatggggcagcccctgaacaacgacgaggaccacgcccactggacggaggccaagatgctcctggacaacatcaacacccccgagggcatcatcccggcgctgttcgagcccgagcgcgagaagtccgccgccatcgacggggagtaccgcctccggggcgaggcccgcaagaccttcgtggagctgatgcggcgcggcgacctgcccgtctggctcagctacaaggtggcctccgaggggttccagtacagcgaccggcgctggtgcttcgacggcgagcggaacaaccaggtgctggaggagaacatggacgtcgagatctggaccaaggagggggagcgcaagaagctgcggccccgctggctcgacgcgcggacctactccgacccgctggccctgcgcgagttcaaggagttcgccgccggccggcgcagcgtgagcggcgacctcatcctggagatcgggaagctgccccagcacctcacgctgcgggcccagaacgcgctggacaacctcgtgatgctgcacaactccgagcagggcgggaaggcctaccgccacgccatggaggagctgcccgacaccatcgagaccctcatgctgctggccctcatcgcggtcctgaccggcggggtgacgctgttcttcctcagcggcaagggcctggggaagacctccatcggcctgctctgcgtgaccgccagctccgccctgctgtggatggccagcgtcgagccccactggatcgccgcgtccatcatcctcgagttcttcctgatggtgctgctcatcccggagcccgaccggcagcgcacgccccaggacaaccagctggcctacgtggtcatcgggctcctgttcatgatcctgacggtggccgccaacgagatgggcctgctcgagaccaccaagaaggacctggggatcggccacgtggccgcggagaaccaccagcacgccaccatgctggacgtcgacctccggccggccagcgcctggacgctgtacgccgtggcgaccaccgtgatcacccccatgatgcgccacacgatcgagaacaccaccgccaacatctccctgaccgccatcgccaaccaggccgcgatcctcatgggcctggacaaggggtggcccatcagcaagatggacatcggcgtccccctgctcgccctggggtgctactcccaggtgaacccgctgacgctcaccgccgccgtgctgatgctggtcgcgcactacgccatcatcggccccgggctccaggccaaggccacccgggaggcccagaagcgcaccgcggccggcatcatgaagaaccccacggtggacggcatcgtggccatcgacctggaccccgtcgtgtacgacgccaagttcgagaagcagctggggcagatcatgctcctgatcctgtgcaccagccagatcctcctgatgcgcaccacctgggccctgtgcgagtccatcacgctcgcgaccggcccgctgaccaccctgtgggaggggagccccggcaagttctggaacacgaccatcgccgtgtccatggccaacatcttccggggcagctacctcgccggggccggcctggcgttctccctgatgaagtccctcgggggcgggcgccggggcaccggcgcccagggggagaccctgggcgagaagtggaagcgccagctgaaccagctctccaagagcgagttcaacacgtacaagcggagcgggatcatggaggtcgaccgctccgaggccaaggagggcctgaagcgcggggagaccaccaagcacgccgtgagccgcggcaccgcgaagctgcggtggttcgtggagcgcaacctggtcaagcccgagggcaaggtgatcgacctcgggtgcggccgcggcgggtggtcctactactgcgccgggctgaagaaggtgaccgaggtcaaggggtacacgaagggcgggcccggccacgaggagccgatccccatggccacctacgggtggaacctggtgaagctccacagcggcaaggacgtgttcttcatgccgcccgagaagtgcgacaccctgctgtgcgacatcggggagtccagcccgaaccccaccatcgaggagggccgcacgctccgggtcctgaagatggtggagccctggctgcgcggcaaccagttctgcatcaagatcctcaacccctacatgccgtccgtggtcgagaccctggagcagatgcagcggaagcacgggggcatgctggtgcgcaaccccctcagccggaactccacccacgagatgtactgggtgagctgcgggaccggcaacatcgtctccgccgtgaacatgacgagccgcatgctgctgaaccggttcaccatggcccaccgcaagcccacctacgagcgcgacgtggacctcggcgcggggacccggcacgtcgccgtggagcccgaggtggccaacctggacatcatcggccagcgcatcgagaacatcaagaacgagcacaagtccacgtggcactacgacgaggacaacccgtacaagacctgggcctaccacgggagctacgaggtcaagccctccggcagcgcctccagcatggtgaacggggtggtccggctgctcaccaagccctgggacgtgatccccatggtcacccagatcgcgatgacggacaccaccccgttcggccagcagcgcgtgttcaaggagaaggtggacacccggacgccccgcgccaagcggggcaccacccagatcatggaggtcaccgccaagtggctgtgggggttcctgtcccgcaacaagaagccccggatctgcacgcgcgaggagttcacccggaaggtgcgcagcaacgccgccatcggcgcggtgttcgtcgacgagaaccagtggaacagcgccaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggcgaagggctcccgggccatctggtacatgtggctcggggcccgcttcctggagttcgaggccctgggcttcatgaacgaggaccactggttcagccgggagaactccctcagcggggtggagggcgaggggctgcacaagctgggctacatcctccgcgacatctccaagatcccgggcgggaacatgtacgccgacgacaccgcgggctgggacacgcggatcaccgaggacgacctgcagaacgaggccaagatcaccgacatcatggagcccgagcacgccctgctcgccaccagcatcttcaagctgacgtaccagaacaaggtggtccgcgtgcagcgccccgccaagaacgggaccgtgatggacgtcatctcccggcgcgaccagcggggcagcggccaggtggggacctacggcctgaacaccttcacgaacatggaggtgcagctcatccgccagatggagtccgaggggatcttcctgcccagcgagctggagaccccgaacctcgcggagcgggtcctggactggctggagaagcacggcgccgagcgcctcaagcggatggccatctccggggacgactgcgtggtgaagcccatcgacgaccgcttcgccaccgccctgaccgcgctgaacgacatgggcaaggtccggaaggacatcccccagtgggagcccagcaagggctggaacgactggcagcaggtcccgttctgctcccaccacttccaccagctcatcatgaaggacgggcgcgagatcgtggtcccctgccggaaccaggacgagctggtgggccgcgcccgggtgagccagggggccggctggtccctgcgcgagaccgcctgcctcggcaagagctacgcccagatgtggcagctgatgtacttccaccggcgcgacctgcggctcgcggccaacgccatctgctccgccgtccccgtggactgggtgcccacgagccgcaccacctggagcatccacgcgcaccaccagtggatgaccacggaggacatgctgtccgtctggaaccgggtgtggatcgaggagaacccgtggatggaggacaagacccacgtgagctcctgggaggaggtcccctacctgggcaagcgcgaggaccagtggtgcggcagcctcatcgggctgaccgcccgcgccacctgggccacgaacatccaggtggccatcaaccaggtgcggcgcctgatcggcaacgagaactacctcgactacatgacctccatgaagcggttcaagaacgagagcgaccccgagggggcgctgtggtga

SEQ ID NO: 8058 - RNA, 9879 nt, synthetic construct
  misc_feature 1..9879: note = derived and/or modified CDS sequence (opt1) from DENV-1__GQ868500__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggggagctctgcgaggacaccatgacctacaagtgcccccagatcaccgaggccgagcccgacgacgtggactgctggtgcaacgccaccgacacctgggtcacctacgggacctgcagccagaccggggagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctggtgatggggcagctgacctggaacgacctcatccgcctgtgcatcatggtgggcgcgaacgcctccgaccgcatggggatgggcaccacgtacctggccctcatggccaccttcaagatgcggccgatgttcgccgtcggcctgctgttccgccggctcaccagccgcgaggtgctgctgctcaccatcgggctgtccctggtggcgagcgtcgagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtgtccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggtccagcgcggacctctccctggagaaggccgccgaggtgagctgggagcaggaggccgagcactccggcaccagccacaacatcctggtggaggtccaggacgacgggaccatgaagatcaaggacgaggagcgcgacgacaccctcacgatcctgctgaaggccaccctcctggcggtgtccggcgtgtaccccatgagcatccccgccaccctgttcgtctggtacttctggcagaagaagaagcagcggtccggggtgctctgggacacccccagcccgcccgaggtggagcgcgccgtcctggacgacggcatctaccggatcctgcagcgcggcctgctcgggcggtcccaggtgggcgtgggggtcttccaggacggcgtgttccacacgatgtggcacgtgacccgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgcggtggagcccgggaagaacccgaagaacgtgcagaccacgcccggcaccttcaagacccccgagggcgaggtcggggccatcgccctggacttcaagcccggcaccagcgggtccccgatcgtgaaccgggagggcaagatcgtgggcctgtacgggaacggcgtcgtgacgaccagcgggacctacgtgtccgccatcgcccaggcgaaggccagccaggagggccccctccccgagatcgaggacgaggtcttcaagaagcgcaacctgaccatcatggacctgcacccggggagcggcaagacgcggcgctacctccccgccatggtgcgggaggccatcaagcgcaagctgcggaccctgatcctcgcgcccacccgcgtggtcgcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtccgggtgcccaactacaacatgatcatcatggacgaggcccacttcacggaccccgccagcatcgccgcccgcggctacatctccacccgggtggggatgggcgaggcggccgccatcttcatgaccgccacgccgcccgggagcgtcgaggccttcccccagtccaacgcggtgatccaggacgaggagcgcgacatccccgagcggagctggaactccggctacgactggatcacggacttccccggcaagaccgtgtggttcgtccccagcatcaagtccgggaacgacatcgccaactgcctgcgcaagaacggcaagcgggtgatccagctcagccgcaagaccttcgacaccgagtaccagaagacgaagaacaacgactgggactacgtggtcaccaccgacatctccgagatgggggccaacttccgggccgaccgcgtgatcgacccccggcgctgcctgaagcccgtgatcctgaaggacggccccgagcgggtcatcctcgcggggccgatgcccgtgaccgtggccagcgccgcccagcgccggggccgcatcggccggaaccagaacaaggagggggaccagtacgtctacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcgtccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtcctcaccgggggcgtgacgctgttcttcctgagcgggaagggcctcggcaagacctccatcgggctgctgtgcgtgaccgccagctccgccctcctgtggatggccagcgtcgagccccactggatcgcggcctccatcatcctggagttcttcctcatggtgctgctgatcccggagcccgaccggcagcgcacgccccaggacaaccagctcgcctacgtggtcatcggcctgctgttcgtgatcctcacggtggccgccaacgagatggggctgctggagaccaccaagaaggacctcggcatcgggcacgtcgcggccgagaaccaccagcacgccaccatgctggacgtggacctgcggccggccagcgcctggacgctctacgcggtggccaccaccgtcatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtgaacccgctgacgctgaccgccgcggtcctcatgctggtggcccactacgccatcatcgggcccggcctgcaggccaaggccacccgggaggcgcagaagcgcaccgccgccgggatcatgaagaaccccacggtggacggcatcgtcgccatcgacctcgaccccgtggtgtacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtctccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgcggtgagccgcgggaccgccaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacacgaagggcggccccgggcacgaggagccgatccccatggccacctacggctggaacctggtgaagctgcacagcgggaaggacgtcttcttcatgccgcccgagaagtgcgacaccctcctgtgcgacatcggcgagtccagcccgaaccccaccatcgaggaggggcgcacgctgcgggtgctcaagatggtggagccctggctgcgcggcaaccagttctgcatcaagatcctgaacccctacatgccgtccgtcgtggagaccctcgagcagatgcagcggaagcacggcgggatgctggtgcgcaaccccctgagccggaactccacccacgagatgtactgggtcagctgcggcaccgggaacatcgtgtccgccgtgaacatgacgagccgcatgctcctgaaccggttcaccatggcgcaccgcaagcccacctacgagcgcgacgtcgacctgggcgccggcacccggcacgtggccgtggagcccgaggtcgccaacctcgacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtgaacggcgtcgtgcggctgctgaccaagccctgggacgtcatccccatggtgaagcagatcgccatgaccgacacgaccccgttcgggcagcagcgcgtgttcaaggagaaggtcgacacccggacgccccgggccaagcggggcacgacccagatcatggaggtgaccgccaagtggctctggggcttcctgtcccgcaacaagaagccccggatctgcacccgcgaggagttcacgcggaaggtgcgcagcaacgccgcgatcggggccgtcttcgtgggcgagaaccagtggaacagcgccaaggaggccgtggaggacgagcgggtctgggacctggtgcaccgcgagcgggagctccacaagcaggggaagtgcgcgacctgcgtgtacaacatgatgggcaagcgcgagaagaagctgggggagttcggcaaggccaagggctcccgggccatctggtacatgtggctgggggcccgcttcctcgagttcgaggccctgggcttcatgaacgaggaccactggttcagccgggagaactccctgagcggggtcgagggcgaggggctccacaagctgggctacatcctgcgcgacatctccaagatcccgggcgggaacatgtacgcggacgacaccgccggctgggacacccggatcacggaggacgacctccagaacgaggccaagatcaccgagatcatggagcccgagcacgccctgctggccaccagcatcttcaagctcacctaccagaacaaggtggtgcgcgtccagcgccccgcgaagaacgggacggtgatggacgtgatctcccggcgcgaccagcggggcagcggccaggtcgggacctacggcctgaacaccttcaccaacatggaggtgcagctgatccgccagatggagtccgaggggatcttcctccccagcgagctggagacgccgaacctggccgagcgggtgctcgactggctggagaagcacggcgccgagcgcctgaagcggatggccatctccggggacgactgcgtcgtgaagcccatcgacgaccgcttcgccaccgcgctcaccgccctgaacgacatgggcaaggtgcggaaggacatcccccagtgggagcccagcaagggctggaacgactggcagcaggtcccgttctgctcccaccacttccaccagctgatcatgaaggacgggcgcgagatcgtggtgccctgccggaaccaggacgagctcgtcggccgcgcccgggtgagccagggggccggctggtccctgcgcgagaccgcctgcctgggcaagagctacgcgcagatgtggcagctcatgtacttccaccggcgcgacctgcggctggccgccaacgccatctgctccgcggtgcccgtcgactgggtgcccaccagccgcacgacctggagcatccacgcccaccaccagtggatgaccaccgaggacatgctctccgtgtggaaccgggtctggatcgaggagaacccgtggatggaggacaagacgcacgtgagctcctgggaggaggtgccctacctgggcaagcgcgaggaccagtggtgcggcagcctgatcgggctcaccgcccgcgccacctgggccaccaacatccaggtcgcgatcaaccaggtgcggcgcctgatcggcaacgagaactacctggactacatgacgtccatgaagcggttcaagaacgagagcgaccccgagggggccctctggtga

SEQ ID NO: 8059 - RNA, 9879 nt, synthetic construct
  misc_feature 1..9879: note = derived and/or modified CDS sequence (opt1) from DENV-1__GU131961__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttccgcctggagaaggaggtcgcggagacgcagcacggcaccgtgctggtgcaggtcaagtacgagggcaccgacgccccctgcaagatccccttctccacccaggacgagaagggggtgacgcagaacggccggctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccggcgcatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgggagctgaagtgcgggtccggcatcttcgtgaccaacgaggtccacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtggtcgtgggggacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacaaccagcgcgcctggaacatctgggaggtggaggactacggcttcgggatcttcacgaccaacatctggctgaagctccgggactcctacacccagatgtgcgaccaccgcctgatgagcgcggccatcaaggactccaaggccgtccacgccgacatgggctactggatcgagagcgagaagaacgagacctggaagctggcccgggcgtccttcatcgaggtgaagacgtgcacctggcccaagagccacaccctctggtccaacggcgtgctggagagcgagatgatcatccccaagatctacgggggcccgatctcccagcacaactaccgccccgggtacttcacccagacggccggcccctggcacctggggaagctcgagctggacttcgacctgtgcgagggcaccaccgtcgtggtggacgagcactgcggcaaccgggggccgagcctccgcaccacgaccgtcaccggcaagatcatccacgagtggtgctgccggtcctgcaccctgccgcccctgcgcttccgcggggaggacggctgctggtacgggatggagatccgccccgtgaaggagaaggaggagaacctcgtgcggagcatggtctccgccggcagcggcgaggtggacagcttctccctggggatcctgtgcgccagcatcatgatcgaggaggtgatgcgctcccggtggagccgcaagatgctcatgacgggcaccctggccgtcttcctgctcctgatcatggggcagctgacctggaacgacctcatccgcctgtgcatcatggtgggcgcgaacgcctccgaccggatggggatgggcaccacgtacctggccctcatggccaccttcaagatgcgcccgatgttcgccgtggggctgctgttccggcgcctcaccagccgggaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccgcaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgggacgacaccctcacgatcctgctgaaggccaccctcctggcggtctccggcgtgtaccccatgagcatccccgccaccctgttcgtgtggtacttctggcagaagaagaagcagcgctccggggtcctctgggacacccccagcccgcccgaggtggagcgggccgtgctggacgacggcatctaccgcatcctgcagcggggcctgctcgggcgctcccaggtcggcgtgggggtgttccaggacggcgtcttccacacgatgtggcacgtgacccgcggggccgtgctgatgtaccagggcaagcgcctggagcccagctgggcctccgtcaagaaggacctcatcagctacggcgggggctggcggttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgcgagggcaagatcgtgggcctgtacgggaacggcgtggtcacgaccagcgggacctacgtgtccgccatcgcccaggcgaaggccagccaggagggccccctccccgagatcgaggacgaggtgttcaagaagcggaacctgaccatcatggacctgcacccggggagcggcaagacgcgccggtacctccccgccatcgtccgcgaggccatcaagcggaagctgcgcaccctgatcctcgcgcccacccgcgtggtggcctccgagatggccgaggccctgaagggcatgcccatccggtaccagaccacggccgtcaagagcgagcacaccgggcgcgagatcgtggacctgatgtgccacgcgaccttcaccatgcggctcctgtccccggtgcgcgtccccaactacaacatgatcatcatggacgaggcccacttcacggaccccgccagcatcgccgcccggggctacatctccacccgcgtggggatgggcgaggcggccgccatcttcatgaccgccacgccgcccgggagcgtggaggccttcccccagtccaacgcggtcatccaggacgaggagcgggacatccccgagcgcagctggaactccggctacgactggatcacggacttccccggcaagaccgtgtggttcgtgcccagcatcaagtccgggaacgacatcgccaactgcctgcggaagaacggcaagcgcgtcatccagctcagccggaagaccttcgacaccgagtaccagaagacgaagaacaacgactgggactacgtggtgaccaccgacatctccgagatgggggccaacttccgcgccgaccgggtcatcgacccccgccggtgcctgaagcccgtgatcctgaaggacggccccgagcgcgtgatcctcgcggggccgatgcccgtcaccgtggccagcgccgcccagcggcgcggccggatcggccgcaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccggctgcgcggggaggcccggaagaccttcgtcgagctcatgcgccggggcgacctgcccgtgtggctgagctacaaggtcgcgtccgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctactccgacccgctcgccctgcgggagttcaaggagttcgccgccgggcgccggagcgtcagcggcgacctgatcctcgagatcggcaagctgccccagcacctgacgctccgcgcgcagaacgccctggacaacctggtgatgctccacaactccgagcagggcgggaaggcctaccggcacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccgccagcggacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcgcccggccagcgcctggacgctctacgcggtcgccaccaccgtgatcacccccatgatgcggcacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgcgaggcgcagaagcgcaccgccgccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcggaccacctgggcgctgtgcgagtccatcacgctggccaccgggccgctcaccaccctgtgggagggcagccccgggaagttctggaacacgaccatcgccgtgtccatggccaacatcttccgcggcagctacctggccggcgcggggctcgccttctccctgatgaagtccctgggcgggggccggcgcgggaccggcgcccagggcgagaccctcggggagaagtggaagcggcagctgaaccagctgtccaagagcgagttcaacacgtacaagcgcagcggcatcatggaggtggaccggtccgaggccaaggaggggctcaagcgcggcgagaccaccaagcacgcggtcagccgggggaccgccaagctgcgctggttcgtggagcggaacctggtgaagcccgagggcaaggtcatcgacctgggctgcgggcgcggcgggtggtcctactactgcgccggcctcaagaaggtgaccgaggtgaaggggtacacgaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccaccatcgaggaggggcggacgctgcgcgtgctcaagatggtcgagccctggctgcggggcaaccagttctgcatcaagatcctgaacccctacatgccgtccgtggtggagaccctcgagcagatgcagcgcaagcacggcgggatgctggtccggaaccccctgagccgcaactccacccacgagatgtactgggtgagctgcggcaccgggaacatcgtgtccgccgtcaacatgacgagccggatgctcctgaaccgcttcaccatggcgcaccgcaagcccaccttcgagcgggacgtggacctgggcgccggcacccgccacgtggccgtcgagcccgaggtggccaacctcgacatcatcgggcagcggatcgagaacatcaagaacgagcacaagtccacgtggcactacgacgaggacaacccgtacaagacctgggcctaccacggcagctacgaggtgaagccctccgggagcgcgtccagcatggtcaacggcgtggtgcgcctgctgaccaagccctgggacgtcatccccatggtgacccagatcgccatgacggacaccaccccgttcgggcagcagcgggtcttcaaggagaaggtggacacccgcacgccccgggccaagcgcggcaccacccagatcatggaggtgaccgccaagtggctctggggcttcctgtcccggaacaagaagccccgcatctgcacgcgggaggagttcacccgcaaggtccggagcaacgccgcgatcggggccgtgttcgtggacgagaaccagtggaacagcgccaaggaggccgtcgaggacgagcgcttctgggacctggtgcaccgggagcgcgagctccacaagcagggcaagtgcgcgacctgcgtgtacaacatgatggggaagcgggagaagaagctgggcgagttcgggaaggccaagggctcccgcgccatctggtacatgtggctgggcgcccggttcctcgagttcgaggccctggggttcatgaacgaggaccactggttcagccgcgagaactccctgagcggcgtcgagggggagggcctccacaagctggggtacatcctgcgggacatctccaagatcccgggcggcaacatgtacgcggacgacaccgccgggtgggacacgcgcatcaccgaggacgacctccagaacgaggccaagatcaccgacatcatggagcccgagcacgccctgctggccaccagcatcttcaagctcacgtaccagaacaaggtggtgcgcgtccagcggcccgcgaagaacggcaccgtgatggacgtgatctcccgccgggaccagcgcgggagcggccaggtcggcacctacgggctgaacaccttcacgaacatggaggtgcagctgatccggcagatggagtccgagggcatcttcctccccagcgagctggagaccccgaacctggccgagcgcgtgctcgactggctggagaagcacggggccgagcggctgaagcgcatggccatctccggcgacgactgcgtcgtgaagcccatcgacgaccggttcgccaccgcgctcaccgccctgaacgacatggggaaggtgcgcaaggacatcccccagtgggagcccagcaagggctggaacgactggcagcaggtcccgttctgctcccaccacttccaccagctgatcatgaaggacggccgggagatcgtggtgccctgccgcaaccaggacgagctcgtcgggcgggcccgcgtgagccagggcgccgggtggtccctgcgggagaccgcctgcctgggcaagagctacgcgcagatgtggcagctcatgtacttccaccgccgggacctgcgcctggccgccaacgccatctgctccgcggtgcccgtcgactgggtgcccacgagccggaccacctggagcatccacgcccaccaccagtggatgaccacggaggacatgctctccgtgtggaaccgcgtctggatcgaggagaacccgtggatggaggacaagacccacgtgagctcctgggaggaggtgccctacctggggaagcgcgaggaccagtggtgcggcagcctgatcggcctcaccgcccgggccacctgggccacgaacatccaggtcgcgatcaaccaggtgcgccggctgatcgggaacgagaactacctggactacatgacctccatgaagcgcttcaagaacgagagcgaccccgagggcgtgctctggtga

SEQ ID NO: 8060 - RNA, 9870 nt, synthetic construct
  misc_feature 1..9870: note = derived and/or modified CDS sequence (opt1) from DENV-1__GU131962__SS-prME
  source 1..9870: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgtgagcatcatgatcgaggaggtcatgcggtcccgctggagccggaagatgctcatgacgggcaccctggccgtgttcctgctcctggtgatggggcagctgacctggaacgacctcatccgcctgtgcatcatggtcggcgccaacgcgtccgaccgcatggggatggggaccacgtacctggccctcatggccaccttcaagatgcggccgatgttcgccgtgggcctgctgttccgccggctcaccagccgcgaggtgctgctgctcaccatcgggctgtccctggtcgccagcgtggagctccccaactccctggaggagctgggcgacgggctcgcgatgggcatcatgatgctgaagctgctcacggagttccagccccaccagctgtggaccaccctgctcagcctgaccttcatcaagacgaccctgtccctcgactacgcctggaagaccaccgccatggccctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggccgtgtccggcgtctaccccatgagcatccccgcgaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcaccagcgggtccccgatcgtgaaccgggagggcaagatcgtcggcctgtacgggaacggcgtggtgacgaccagcgggacctacgtctccgccatcgcccaggccaaggcgagccaggagggccccctccccgagatcgaggacgaggtgttcaagaagcgcaacctgaccatcatggacctgcacccggggagcggcaagacgcggcgctacctccccgccatcgtgcgggaggccatcaagcgcaagctgcggaccctgatcctcgcccccacccgcgtcgtggcgtccgagatggccgaggccctgaagggcatgcccatccgctaccagaccacggccgtcaagagcgagcacaccgggcgggagatcgtcgacctgatgtgccacgccaccttcaccatgcgcctcctgtccccggtgcgggtgcccaactacaacatgatcatcatggacgaggcgcacttcacggaccccgccagcatcgccgcccgcggctacatctccacccgggtcgggatgggcgaggccgcggccatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgcgaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgccgggccgatgcccgtgaccgtcgcgagcgccgcccagcgccggggccgcatcggccggaaccagaacaaggagggggaccagtacgtgtacatgggccagcccctgaacaacgacgaggaccacgcccactggacggaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtggcctccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcgcggacctactccgacccgctcgccctgcgcgagttcaaggagttcgccgccgggcggcgcagcgtgagcggcgacctgatcctcgagatcggcaagctgccccagcacctgacgctccgggcccagaacgcgctggacaacctggtcatgctccacaactccgagcagggcgggaaggcctaccgccacgccatggaggagctgcccgacaccatcgagaccctgatgctcctggccctgatcgcggtgctcaccgggggcgtgacgctgttcttcctgagcgggaagggcctcggcaagacctccatcgggctgctgtgcgtcaccgccagctccgccctcctgtggatggccagcgtggagccccactggatcgccgcgtccatcatcctggagttcttcctcatggtgctgctgatcccggagcccgaccggcagcgcacgccccaggacaaccagctcgcctacgtcgtgatcggcctgctgttcatgatcctcacggtggccgccaacgagatggggctgctggagaccaccaagaaggacctcggcatcgggcacgtcgccgcggagaaccaccagcacgccaccatgctggacgtggacctgcggccggccagcgcctggacgctctacgccgtggcgaccaccgtcatcacccccatgatgcgccacacgatcgagaacaccaccgccaacatctccctgaccgccatcgccaaccaggccgcgatcctgatgggcctcgacaagggctggcccatcagcaagatggacatcggggtgcccctgctggccctcggctgctactcccaggtgaacccgctgacgctgaccgccgccgtcctcatgctggtggcgcactacgccatcatcgggcccggcctgcaggccaaggccacccgggaggcccagaagcgcaccgcggccgggatcatgaagaaccccacggtggacggcatcgtcgccatcgacctcgaccccgtggtgtacgacgccaagttcgagaagcagctgggccagatcatgctgctcatcctgtgcaccagccagatcctgctcatgcgcaccacctgggccctgtgcgagtccatcacgctggcgaccgggccgctcaccaccctgtgggagggcagccccgggaagttctggaacacgaccatcgccgtctccatggccaacatcttccggggcagctacctggccggcgccgggctcgcgttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgccgtgagccgcgggaccgcgaagctgcggtggttcgtcgagcgcaacctggtgaagcccgagggcaaggtgatcgacctgggctgcgggcggggcgggtggtcctactactgcgccggcctcaagaaggtcaccgagtacgccagcgccgggctggccatcatcgtgcccctgccgctcgacacgtacggccgcaaccggctgaagatccactccggcaaggacgtgttcttcatgccgcccgagaagggggacaccctgctctgcgacatcggcgagagctcccccaacccgaccatcgaggaggggcgcaccctgcgggtcctgaagatggtggagccctggctccgcggcaaccagttctgcatcaagatcctgaacccctacatgcccagcgtggtcgaggcgctggagcagatgcagcggaagcacgggggcatgctcgtgcgcaacccgctgtcccggaacagcacgcacgagatgtactgggtgtcctgcggcaccgggaacatcgtcagcgccgtgaacatgacctcccgcatgctgctcaaccgcttcaccatggcccaccggaagcccacgtacgagcgcgacgtggacctgggcgccgggacccggcacgtcgccgtggagcccgaggtggcgaacctggacatcatcggccagcgcatcgagaacatcaagaacgagcacaagagcacctggcactacgacgaggacaacccctacaagacctgggcctaccacggctcctacgaggtcaagccgagcgggtccgccagctccatggtgaacggcgtggtccggctcctgacgaagccctgggacgtgatccccatggtcacccagatcgccatgaccgacaccacgcccttcgggcagcagcgcgtgttcaaggagaaggtggacacccggaccccgcgcgccaagcggggcaccacgcagatcatggaggtcaccgcgaagtggctgtgggggttcctcagccgcaacaagaagccccggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctgcacaagcagggcaagtgcgccacgtgcgtctacaacatgatggggaagcgcgagaagaagctcggcgagttcgggaaggccaagggcagccgggccatctggtacatgtggctgggggcgcgcttcctggagttcgaggccctcggcttcatgaacgaggaccactggttctcccgggagaacagcctgtccggcgtggagggggagggcctgcacaagctcgggtacatcctgcgcgacatcagcaagatccccggcgggaacatgtacgccgacgacaccgccggctgggacacccgcatcaccgaggacgacctgcagaacgaggccaagatcacggagatcatggagccggagcacgcgctcctggccacctccatcttcaagctgacctaccagaacaaggtggtccgggtgcagcgccccgccaagaacggcaccgtgatggacgtcatcagccggcgcgaccagcgggggtccggccaggtggggacgtacggcctcaacaccttcaccaacatggaggtgcagctgatccgccagatggagagcgagggcatcttcctgccctccgagctcgagacccccaacctggccgagcgggtcctggactggctcgagaagcacggggccgagcgcctgaagcggatggcgatcagcggcgacgactgcgtggtgaagccgatcgacgaccgcttcgccacggccctgaccgccctcaacgacatggggaaggtccggaaggacatcccccagtgggagccctccaagggctggaacgactggcagcaggtccccttctgcagccaccacttccaccagctgatcatgaaggacgggcgcgagatcgtggtcccgtgccggaaccaggacgagctggtgggccgcgcccgggtgtcccagggcgcggggtggagcctccgcgagaccgcctgcctgggcaagtcctacgcccagatgtggcagctgatgtacttccaccggcgcgacctccggctggccgcgaacgccatctgcagcgccgtccccgtggactgggtgcccaccagccgcaccacgtggtccatccacgcccaccaccagtggatgaccaccgaggacatgctgagcgtctggaaccgcgtgtggatcgaggagaacccctggatggaggacaagacccacgtgtccagctgggaggaggtcccgtacctcgggaagcgggaggaccagtggtgcggctccctgatcgggctgacggcccgcgcgacctgggccaccaacatccaggtggccatcaaccaggtgcggcgcctcatcggcaacgagaactacctggactacatgaccagcatgaagcggttcaagaacgagtccgaccccgagggcgccctgtggtga

SEQ ID NO: 8061 - RNA, 9879 nt, synthetic construct
  misc_feature 1..9879: note = derived and/or modified CDS sequence (opt1) from DENV-1__GU131963__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccttcttcctggcgcacgccatcggcaccagcatcacccagaaggggatcatcttcatcctcctgatgctggtgaccccctccatggccatgcgctgcgtcggcatcggcaaccgggacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcgatcctgcgcaagctctgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcgggctgttcggcaaggggagcctcctgacgtgcgccaagttcaagtgcgtgaccaagctggagggcaagatcgtgcagtacgagaacctcaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctgaccctcgactgcagcccccggaccggcctggacttcaacgagatggtgctgctcacgatgaaggagaagtcctggctggtccacaagcagtggttcctggacctcccgctgccctggacctccggggccagcaccagccaggagacctggaaccgccaggacctgctcgtgacgttcaagaccgcccacgcgaagaagcaggaggtggtcgtgctgggctcccaggagggcgccatgcacaccgccctgaccggggccacggagatccagaccagcggcaccaccacgatcttcgccgggcacctcaagtgccggctgaagatggacaagctgaccctcaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctgatcaccgccaacccgatcgtgaccgacaaggagaagcccgtcaacatcgagaccgagccgcccttcggggagagctacatcgtggtgggcgccggcgagaaggcgctcaagctgtcctggttcaagaaggggagctccatcggcaagatgttcgaggccacggcccgcggggcgcgccggatggccatcctgggcgacaccgcgtgggacttcgggagcatcggcggcgtcttcacctccgtggggaagctcgtgcaccaggtcttcggcaccgcctacggggtgctgttcagcggcgtgtcctggacgatgaagatcgggatcggcatcctgctcacctggctgggcctgaacagccgctccaccagcctctccatgacctgcatcgccgtcgggatggtgacgctgtacctgggcgtgatggtccaggccgacagcgggtgcgtgatcaactggaagggccgcgagctcaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcacggtggtcgtgggggacgccaacggcatcctcgcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctgcgcgactcctacacccagatgtgcgaccaccggctcatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctgtggtccaacggcgtgctcgagagcgagatgatcatccccaagatctacgggggcccgatctcccagcacaactaccggcccgggtacttcacccagacggccggcccctggcacctggggaagctggagctcgacttcgacctgtgcgagggcaccaccgtcgtggtggacgagcactgcggcaaccgcgggccgagcctgcggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctggtgcgcagcatggtctccgccggcagcggcgaggtggacagcttctccctcgggatcctgtgcgtgagcatcatgatcgaggaggtcatgcggtcccgctggagccggaagatgctgatgacgggcaccctcgccgtgttcctgctgctcgtgatggggcagctgacctggaacgacctgatccgcctctgcatcatggtcggcgccaacgcgtccgaccgcatggggatgggcaccacgtacctggccctgatggccaccttcaagatgcggccgatgttcgccgtgggcctcctgttccgccggctgaccagccgcgaggtgctcctgctgaccatcgggctctccctggtcgccagcgtggagctgcccaactccctcgaggagctgggcgacgggctggcgatgggcatcatgatgctcaagctgctgacggagttccagccccaccagctctggaccaccctgctgagcctcaccttcatcaagacgaccctgtccctggactacgcctggaagaccaccgccatggccctcagcatcgtctccctgttccccctgtgcctcagcacgacctcccagaagaccacctggctgccggtgctgctcggcagcttcgggtgcaagcccctgaccatgttcctgatcacggagaacaagatctggggccggaagtcctggcccctcaacgaggggatcatggcgatcggcatcgtgagcatcctgctgtccagcctcctgaagaacgacgtccccctggccgggccgctcatcgccggcggcatgctgatcgcctgctacgtgatcagcgggtccagcgccgacctgtccctcgagaaggcggccgaggtgagctgggagcaggaggccgagcactccggcaccagccacaacatcctggtcgaggtgcaggacgacgggaccatgaagatcaaggacgaggagcgcgacgacaccctgacgatcctcctgaaggccaccctgctcgccgtgtccggcgtctaccccatgagcatccccgcgaccctgttcgtgtggtacttctggcagaagaagaagcagcggtccggggtgctgtgggacacccccagcccgcccgaggtcgagcgcgccgtgctcgacgacggcatctaccggatcctgcagcgcggcctgctggggcggtcccaggtgggcgtcggggtgttccaggacggcgtgttccacacgatgtggcacgtcacccgcggggccgtgctcatgtaccagggcaagcggctggagcccagctgggcctccgtgaagaaggacctgatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggcgatcgccctcgacttcaagcccggcaccagcgggtccccgatcgtgaaccgggagggcaagatcgtcggcctgtacgggaacggcgtggtgacgaccagcgggacctacgtctccgccatcgcccaggccaaggcgagccaggagggccccctgcccgagatcgaggacgaggtgttcaagaagcgcaacctcaccatcatggacctgcacccggggagcggcaagacgcggcgctacctgcccgccatcgtgcgggaggccatcaagcgcaagctccggaccctgatcctggcccccacccgcgtcgtggcgtccgagatggccgaggccctcaagggcatgcccatccgctaccagaccacggccgtcaagagcgagcacaccgggcgggagatcgtcgacctgatgtgccacgccaccttcaccatgcgcctgctctccccggtgcgggtgcccaactacaacatgatcatcatggacgaggcgcacttcacggaccccgccagcatcgccgcccgcggctacatctccacccgggtcgggatgggcgaggccgcggccatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgcgaactgcctgcgcaagaacggcaagcgggtgatccagctgagccgcaagaccttcgacaccgagtaccagaagacgaagaacaacgactgggactacgtcgtgaccaccgacatctccgagatgggggccaacttccgggccgaccgcgtgatcgacccccggcgctgcctcaagcccgtcatcctgaaggacggccccgagcgggtgatcctggccgggccgatgcccgtgaccgtcgcgagcgccgcccagcgccggggccgcatcggccggaaccagaacaaggagggggaccagtacgtgtacatgggccagcccctcaacaacgacgaggaccacgcccactggacggaggccaagatgctgctggacaacatcaacacccccgaggggatcatcccggccctcttcgagcccgagcgcgagaagtccgccgccatcgacggcgagtaccgcctgcgcggggaggcccgcaagaccttcgtcgagctgatgcggcgcggcgacctccccgtgtggctgagctacaaggtggcctccgagggcttccagtacagcgaccggcgctggtgcttcgacggggagcggaacaaccaggtcctggaggagaacatggacgtggagatctggaccaaggagggcgagcgcaagaagctccggccccgctggctggacgcgcggacctactccgacccgctggccctccgcgagttcaaggagttcgccgccgggcggcgcagcgtgagcggcgacctgatcctggagatcggcaagctcccccagcacctgacgctgcgggcccagaacgcgctcgacaacctggtcatgctgcacaactccgagcagggcgggaaggcctaccgccacgccatggaggagctccccgacaccatcgagaccctgatgctgctcgccctgatcgcggtgctgaccgggggcgtgaccctcttcttcctgagcgggaagggcctgggcaagacctccatcgggctcctgtgcgtcaccgccagctccgccctgctctggatggccagcgtggagccccactggatcgccgcgtccatcatcctggagttcttcctgatggtgctcctgatcccggagcccgaccggcagcgcacgccccaggacaaccagctggcctacgtcgtgatcggcctcctgttcatgatcctgacggtggccgccaacgagatggggctcctggagaccaccaagaaggacctgggcatcgggcacgtcgccgcggagaaccaccagcacgccaccatgctcgacgtggacctgcggccggccagcgcctggacgctgtacgccgtggcgaccaccgtcatcacccccatgatgcgccacacgatcgagaacaccaccgccaacatctccctcaccgccatcgccaaccaggccgcgatcctgatgggcctggacaagggctggcccatcagcaagatggacatcggggtgcccctcctggccctgggctgctactcccaggtgaacccgctcacgctgaccgccgccgtcctgatgctcgtggcgcactacgccatcatcgggcccggcctgcaggccaaggccacccgggaggcccagaagcgcaccgcggccgggatcatgaagaaccccacggtggacggcatcgtcgccatcgacctggaccccgtggtgtacgacgccaagttcgagaagcagctcggccagatcatgctgctgatcctctgcaccagccagatcctgctgatgcgcaccacctgggccctctgcgagtccatcacgctggcgaccgggccgctgaccaccctctgggagggcagccccgggaagttctggaacacgaccatcgccgtctccatggccaacatcttccggggcagctacctggccggcgccgggctggcgttctccctcatgaagtccctgggcgggggccgccgggggaccggcgcccagggcgagaccctgggggagaagtggaagcgccagctcaaccagctgtccaagagcgagttcaacacgtacaagcggagcggcatcatggaggtggaccgctccgaggccaaggaggggctgaagcggggcgagaccaccaagcacgccgtgagccgcgggaccgcgaagctccggtggttcgtcgagcgcaacctggtgaagcccgagggcaaggtgatcgacctgggctgcgggcggggcgggtggtcctactactgcgccggcctgaagaaggtcaccgaggtgaaggggtacacgaagggcggccccgggcacgaggagccgatccccatggccacctacggctggaacctcgtgaagctgcacagcgggaaggacgtcttcttcatgccgcccgagaagtgcgacaccctgctctgcgacatcggcgagtccagcccgaaccccaccatcgaggaggggcgcacgctgcgggtgctgaagatggtggagccctggctccgcggcaaccagttctgcatcaagatcctgaacccctacatgccgtccgtcgtggaggccctggagcagatgcagcggaagcacggcgggatgctcgtgcgcaaccccctgagccggaactccacccacgagatgtactgggtcagctgcggcaccgggaacatcgtgtccgccgtgaacatgaccagccgcatgctgctcaaccggttcacgatggcgcaccgcaagcccacctacgagcgcgacgtcgacctgggcgccggcacccggcacgtggccgtggagcccgaggtcgccaacctggacatcatcgggcagcgcatcgagaacatcaagaacgagcacaagtccacctggcactacgacgaggacaacccgtacaagacgtgggcctaccacggcagctacgaggtgaagccctccgggagcgcgtccagcatggtgaacggcgtcgtgcggctcctgaccaagccctgggacgtcatccccatggtgacccagatcgccatgaccgacacgaccccgttcgggcagcagcgcgtgttcaaggagaaggtcgacacccggacgccccgggccaagcggggcacgacccagatcatggaggtgaccgccaagtggctgtggggcttcctctcccgcaacaagaagccccggatctgcacccgcgaggagttcacgcggaaggtgcgcagcaacgccgcgatcggggccgtcttcgtggacgagaaccagtggaacagcgccaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggctcccgggccatctggtacatgtggctgggcgcccgcttcctggagttcgaggccctcgggttcatgaacgaggaccactggttcagccgggagaactccctgagcggcgtggagggggagggcctgcacaagctcgggtacatcctgcgcgacatctccaagatcccgggcggcaacatgtacgcggacgacaccgccgggtgggacacccggatcacggaggacgacctgcagaacgaggccaagatcaccgagatcatggagcccgagcacgccctcctggccaccagcatcttcaagctgacctaccagaacaaggtcgtgcgcgtgcagcgccccgcgaagaacggcacggtcatggacgtgatctcccggcgcgaccagcgggggagcggccaggtgggcacctacgggctcaacaccttcaccaacatggaggtccagctgatccgccagatggagtccgagggcatcttcctgcccagcgagctcgagacgccgaacctggccgagcgggtgctggactggctcgagaagcacggggccgagcgcctgaagcggatggccatctccggcgacgactgcgtggtcaagcccatcgacgaccgcttcgccaccgcgctgaccgccctcaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctggtggggcgcgcccgggtcagccagggcgccgggtggtccctccgcgagaccgcctgcctgggcaagagctacgcgcagatgtggcagctgatgtacttccaccggcgcgacctccggctggccgccaacgccatctgctccgcggtgcccgtggactgggtccccaccagccgcacgacctggagcatccacgcccaccaccagtggatgaccaccgaggacatgctgtccgtgtggaaccgggtgtggatcgaggagaacccgtggatggaggacaagacgcaggtcagctcctgggaggaggtgccctacctcgggaagcgcgaggaccagtggtgcggcagcctgatcggcctgaccgcccgcgccacctgggccaccaacatccaggtggcgatcaaccaggtccggcgcctcatcgggaacgagaactacctggactacatgacgtccatgaagcggttcaagaacgagagcgaccccgagggcgccctgtggtga

SEQ ID NO: 8062 - RNA, 9879 nt, synthetic construct
  misc_feature 1..9879: note = derived and/or modified CDS sequence (opt1) from DENV-1__KF955442__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgacggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgcggtcagccgcgggaccgccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacacgaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccaccatcgaggaggggcgcacgctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacccacgagatgtactgggtgagctgcggcaccgggaacatcgtgtccgccgtcaacatgacgagccgcatgctcctgaaccggttcaccatggcgcaccgcaagcccaccttcgagcgcgacgtggacctgggcgccggcacccggcacgtggccgtcgagcccgaggtggccaacctcgacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtcaacggcgtggtgcggctgctgaccaagccctgggacgtcatccccatggtgacccagatcgccatgacggacaccaccccgttcgggcagcagcgcgtcttcaaggagaaggtggacacccggacgccccgcgccaagcggggcaccacccagatcatggaggtgaccgccaagtggctctggggcttcctgtcccgcaacaagaagccccggatctgcacgcgcgaggagttcacccggaaggtccgcagcaacgccgcgatcggggccgtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgcggacgacaccgccgggtgggacacgcggatcaccgaggacgacctccagaacgaggccaagatcaccgacatcatggagcccgagcacgccctgctggccaccagcatcttcaagctcacgtaccagaacaaggtggtgcgcgtccagcgccccgcgaagaacggcaccgtgatggacgtgatctcccggcgcgaccagcgggggagcggccaggtcggcacctacgggctgaacaccttcacgaacatggaggtgcagctgatccgccagatggagtccgagggcatcttcctccccagcgagctggagaccccgaacctggccgagcgggtgctcgactggctggagaagcacggggccgagcgcctgaagcggatggccatctccggcgacgactgcgtcgtgaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgctccgcggtgcccgtcgactgggtgcccacgagccgcaccacctggagcatccacgcccaccaccagtggatgaccacggaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcaccgcccgcgccacctgggccacgaacatccaggtcgcgatcaaccaggtgcggcgcctgatcgggaacgagaactacctggactacatgacctccatgaagcggttcaagaacgagagcgaccccgagggcgccctctggtga

SEQ ID NO: 8063 - RNA, 9879 nt, synthetic construct
  misc_feature 1..9879: note = derived and/or modified CDS sequence (opt1) from DENV-1__GU131965__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgggtcgagacctgggtgctgcggcaccccgggttcacggtgatcgccctgttcctcgcccacgcgatcggcaccagcatcacccagaaggggatcatcttcatcctgctgatgctcgtcaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccatcctccgcaagctgtgcatcgaggcgaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgccaccatcacgccccaggcgcccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgccaagaagcaggaggtcgtggtgctgggctcccaggagggcgcgatgcacaccgccctcaccggggccacggagatccagaccagcggcaccaccacgatcttcgccgggcacctgaagtgccggctgaagatggacaagctcaccctgaagggcacctcctacgtcatgtgcaccgggagcttcaagctggagaaggaggtggccgagacgcagcacggcaccgtgctggtccaggtgaagtacgagggcaccgacgcgccctgcaagatccccttctccacccaggacgagaagggggtgacgcagaacggccgcctcatcaccgccaacccgatcgtcaccgacaaggagaagcccgtgaacatcgagaccgagccgcccttcggggagagctacatcgtggtcggcgccggcgagaaggccctgaagctgtcctggttcaagaaggggagctccatcggcaagatgttcgaggcgacggcccgcggggcccgccggatggccatcctcggcgacaccgcctgggacttcgggagcatcggcggcgtgttcacctccgtggggaagctggtccaccaggtgttcggcaccgcgtacggggtgctgttcagcggcgtctcctggacgatgaagatcgggatcggcatcctcctgacctggctgggcctcaacagccgcaacacctccctgagcatgacctgcatcgccgtggggatggtgacgctgtacctcggcgtcatggtgcaggccgactccgggtgcgtgatcaactggaagggccgcgagctgaagtgcgggagcggcatcttcgtcaccaacgaggtgcacacctggaccgagcagtacaagttccaggccgactccccgaagcggctgagcgccgcgatcggcaaggcctgggaggagggggtgtgcggcatccgcagcgccacccggctcgagaacatcatgtggaagcagatctccaacgagctgaaccacatcctgctcgagaacgacatgaagttcacggtcgtggtgggggacgccaacggcatcctggcccaggggaagaagatgatccgcccccagcccatggagcacaagtacagctggaagtcctggggcaaggcgaagatcatcggcgccgacatccagaacaccaccttcatcatcgacgggcccgacaccccggagtgccccgacaaccagcgggcctggaacatctgggaggtcgaggactacggcttcgggatcttcacgaccaacatctggctgaagctccgcgacagctacacccagatgtgcgaccaccggctgatgtccgccgcgatcaaggacagcaaggccgtgcacgccgacatgggctactggatcgagtccgagaagaacgagacctggaagctggcccgcgccagcttcatcgaggtgaagacgtgcacctggcccaagtcccacaccctctggagcaacggcgtcctggagtccgagatgatcatccccaagatctacgggggcccgatcagccagcacaactaccggcccgggtacttcacccagacggcgggcccctggcacctggggaagctcgagctggacttcgacctgtgcgagggcaccaccgtggtggtcgacgagcactgcggcaaccgcgggccgtccctccggaccacgaccgccaccggcaagatcatccacgagtggtgctgccgcagctgcaccctgccgcccctgcggttccgcggggaggacggctgctggtacgggatggagatccggcccgtgaaggagaaggaggagaacctcgtgcgctccatggtcagcgccggctccggcgaggtggacagcttcagcctggggatcctgtgcgcctccatcatgatcgaggaggtgatgcggagccgctggtcccggaagatgctcatgacgggcaccctggccgtcttcctgctcctggtgatggggcagctgacctggaacgacctcatccgcctgtgcatcatggtgggcgcgaacgccagcgaccgcatggggatgggcaccacgtacctggccctcatggccaccttcaagatgcggccgatgttcgccgtcgggctgctgttccgccggctcacctcccgcgaggtgctgctgctcaccatcgggctgagcctggtggcgtccgtcgagctccccaacagcctggaggagctgggcgacgggctcgccatgggcatcatgatgctgaagctgctcacggagttccagccccaccagctgtggaccaccctgctctccctgaccttcatcaagacgaccctgagcctcgactacgcctggaagaccaccgccatggcgctgtccatcgtgagcctgttccccctctgcctgtccacgaccagccagaagaccacctggctgccggtcctcctgggctccttcgggtgcaagcccctgaccatgttcctcatcacggagaacaagatctggggccgcaagagctggcccctgaacgaggggatcatggccatcggcatcgtgtccatcctgctcagctccctgctgaagaacgacgtgcccctcgccgggccgctgatcgccggcggcatgctgatcgcctgctacgtcatcagcgggagctccgcggacctcagcctggagaaggccgccgaggtgtcctgggagcaggaggccgagcacagcggcacctcccacaacatcctggtggaggtccaggacgacgggaccatgaagatcaaggacgaggagcgcgacgacaccctcacgatcctgctgaaggccaccctcctggcggtgagcggcgtgtaccccatgtccatccccgccaccctgttcgtctggtacttctggcagaagaagaagcagcggagcggggtgctctgggacaccccctccccgcccgaggtggagcgcgccgtcctggacgacggcatctaccggatcctgcagcgcggcctgctcgggcggagccaggtgggcgtgggggtcttccaggacggcgtgttccacacgatgtggcacgtgacccgcggggccgtcctgatgtaccagggcaagcggctggagccctcctgggccagcgtgaagaaggacctcatctcctacggcgggggctggcgcttccaggggagctggaacaccggcgaggaggtgcaggtcatcgcggtggagcccgggaagaacccgaagaacgtgcagaccacgcccggcaccttcaagacccccgagggcgaggtcggggccatcgccctggacttcaagcccggcacctccgggagcccgatcgtgaaccgggagggcaagatcgtgggcctgtacgggaacggcgtcgtgacgacctccgggacctacgtgagcgccatcgcccaggcgaaggcctcccaggagggccccctccccgagatcgaggacgaggtcttcaagaagcgcaacctgaccatcatggacctgcacccggggagcggcaagacgcggcgctacctccccgccatcgtgcgggaggccatcaagcgcaagctgcggaccctgatcctcgcgcccacccgcgtggtcgccagcgagatggccgaggccctgaagggcatgcccatccgctaccagaccacggccgtgaagtccgagcacaccgggcgggagatcgtggacctgatgtgccacgcgaccttcaccatgcgcctcctgagcccggtccgggtgcccaactacaacatgatcatcatggacgaggcccacttcacggaccccgcctccatcgccgcccgcggctacatcagcacccgggtggggatgggcgaggcggccgccatcttcatgaccgccacgccgcccgggtccgtcgaggccttcccccagagcaacgcggtgatccaggacgaggagcgcgacatccccgagcggtcctggaacagcggctacgactggatcacggacttccccggcaagaccgtgtggttcgtcccctccatcaagagcgggaacgacatcgccaactgcctgcgcaagaacggcaagcgggtgatccagctctcccgcaagaccttcgacaccgagtaccagaagacgaagaacaacgactgggactacgtggtcaccaccgacatcagcgagatgggggccaacttccgggccgaccgcgtgatcgacccccggcgctgcctgaagcccgtgatcctgaaggacggccccgagcgggtcatcctcgcggggccgatgcccgtgaccgtggcctccgccgcccagcgccggggccgcatcggccggaaccagaacaaggagggggaccagtacgtctacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtggagctcatgcggcgcggcgacctgcccgtctggctgtcctacaaggtggcgagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcccggacctacagcgacccgctcgccctgcgcgagttcaaggagttcgccgccgggcggcgctccgtgagcggcgacctgatcctcgagatcggcaagctgccccagcacctgacgctccgggcgcagaacgccctggacaacctggtgatgctccacaacagcgagcagggcgggaaggcctaccgccacgccatggaggagctgcccgacaccatcgagaccctgatgctcctggcgctgatcgccgtcctcaccgggggcgtgacgctgttcttcctgtccgggaagggcctcggcaagaccagcatcgggctgctgtgcgtgaccgcctccagcgccctcctgtggatggcctccgtcgagccccactggatcgcggccagcatcatcctggagttcttcctcatggtgctgctgatcccggagcccgaccggcagcgcacgccccaggacaaccagctcgcctacgtggtcatcggcctgctgttcatgatcctcacggtggccgccaacgagatggggctgctggagaccaccaagaaggacctcggcatcgggcacgtggcggccgagaaccaccagcacgccaccatgctggacgtcgacctgcggccggcctccgcctggacgctctacgcggtggccaccaccgtgatcacccccatgatgcgccacacgatcgagaacaccaccgccaacatcagcctgaccgccatcgccaaccaggcggccatcctgatgggcctcgacaagggctggcccatctccaagatggacatcggggtccccctgctggccctcggctgctacagccaggtgaacccgctgacgctgaccgccgcggtgctcatgctggtcgcccactacgccatcatcgggcccggcctgcaggccaaggccacccgggaggcgcagaagcgcaccgccgccgggatcatgaagaaccccacggtggacggcatcgtggccatcgacctcgaccccgtcgtgtacgacgccaagttcgagaagcagctgggccagatcatgctgctcatcctgtgcacctcccagatcctgctcatgcgcaccacctgggcgctgtgcgagagcatcacgctggccaccgggccgctcaccaccctgtgggagggctcccccgggaagttctggaacacgaccatcgccgtgagcatggccaacatcttccggggctcctacctggccggcgcggggctcgccttcagcctgatgaagtccctgggcgggggccgccgggggaccggcgcccagggcgagaccctcggggagaagtggaagcgccagctgaaccagctgagcaagtccgagttcaacacgtacaagcggagcggcatcatggaggtcgaccgcagcgaggccaaggaggggctcaagcggggcgagaccaccaagcacgcggtgtcccgcgggaccgccaagctgcggtggttcgtggagcgcaacctggtcaagcccgagggcaaggtgatcgacctgggctgcgggcggggcgggtggagctactactgcgccggcctcaagaaggtgaccgaggtcaaggggtacacgaagggcggccccgggcacgaggagccgatccccatggccacctacggctggaacctggtgaagctgcactccgggaaggacgtgttcttcatgccgcccgagaagtgcgacaccctcctgtgcgacatcggcgagagctccccgaaccccaccatcgaggaggggcgcacgctgcgggtcctcaagatggtggagccctggctgcgcggcaaccagttctgcatcaagatcctgaacccctacatgccgagcgtggtcgagaccctcgagcagatgcagcggaagcacggcgggatgctggtgcgcaaccccctgtcccggaacagcacccacgagatgtactgggtgtcctgcggcaccgggaacatcgtcagcgccgtgaacatgacgtcccgcatgctcctgaaccggttcaccatggcgcaccgcaagcccacctacgagcgcgacgtggacctgggcgccggcacccggcacgtcgccgtggagcccgaggtggccaacctcgacatcatcgggcagcgcatcgagaacatcaagaacgagcacaagagcacgtggcactacgacgaggacaacccgtacaagacctgggcctaccacggctcctacgaggtcaagcccagcgggtccgcgagctccatggtgaacggcgtggtccggctgctgaccaagccctgggacgtgatccccatggtcacccagatcgccatgacggacaccaccccgttcgggcagcagcgcgtgttcaaggagaaggtggacacccggacgccccgcgccaagcggggcaccacccagatcatggaggtcaccgccaagtggctctggggcttcctgagccgcaacaagaagccccggatctgcacgcgcgaggagttcacccggaaggtgcgctccaacgccgcgatcggggccgtgttcgtcgacgagaaccagtggaacagcgccaaggaggccgtggaggacgagcggttctgggacctggtgcaccgcgagcgggagctccacaagcagggcaagtgcgcgacctgcgtctacaacatgatggggaagcgcgagaagaagctgggcgagttcgggaaggccaagggcagccgggccatctggtacatgtggctgggcgcccgcttcctcgagttcgaggccctggggttcatgaacgaggaccactggttctcccgggagaacagcctgtccggcgtggagggggagggcctccacaagctggggtacatcctgcgcgacatcagcaagatcccgggcggcaacatgtacgcggacgacaccgccgggtgggacacgcggatcaccgaggacgacctccagaacgaggccaagatcaccgagatcatggagcccgagcacgccctgctggccacctccatcttcaagctcacgtaccagaacaaggtggtccgcgtgcagcgccccgcgaagaacggcaccgtgatggacgtcatcagccggcgcgaccagcgggggtccggccaggtgggcacctacgggctgaacaccttcacgaacatggaggtgcagctgatccgccagatggagagcgagggcatcttcctcccctccgagctggagaccccgaacctggccgagcgggtcctcgactggctggagaagcacggggccgagcgcctgaagcggatggccatcagcggcgacgactgcgtggtgaagcccatcgacgaccgcttcgccaccgcgctcaccgccctgaacgacatggggaaggtccggaaggacatcccccagtgggagccctccaagggctggaacgactggcagcaggtcccgttctgcagccaccacttccaccagctgatcatgaaggacggccgcgagatcgtggtcccctgccggaaccaggacgagctcgtggggcgcgcccgggtgtcccagggcgccgggtggagcctgcgcgagaccgcctgcctgggcaagtcctacgcgcagatgtggcagctcatgtacttccaccggcgcgacctgcggctggccgccaacgccatctgcagcgcggtccccgtggactgggtgcccacgtcccgcaccacctggagcatccacgcccaccaccagtggatgaccacggaggacatgctcagcgtctggaaccgggtgtggatcgaggagaacccgtggatggaggacaagacccacgtgtccagctgggaggaggtcccctacctggggaagcgcgaggaccagtggtgcggctccctgatcggcctcaccgcccgcgccacctgggccacgaacatccaggtggcgatcaaccaggtgcggcgcctgatcgggaacgagaactacctggactacatgaccagcatgaagcggttcaagaacgagtccgaccccgagggcgccctctggtga

SEQ ID NO: 8064 - RNA, 9879 nt, synthetic construct
  misc_feature 1..9879: note = derived and/or modified CDS sequence (opt1) from DENV-1__GU131966__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtaccggcgcagcggcatcatggaggtggaccggtccgaggccaaggaggggctcaagcgcggcgagaccaccaagcacgcggtcagccgggggaccgccaagctgcgctggttcgtggagcggaacctggtgaagcccgagggcaaggtcatcgacctgggctgcgggcgcggcgggtggtcctactactgcgccggcctcaagaaggtgaccgaggtgaaggggtacacgaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccaccatcgaggaggggcggacgctgcgcgtgctcaagatggtcgagccctggctgcggggcaaccagttctgcatcaagatcctgaacccctacatgccgtccgtggtggagaccctcgagcagatgcagcgcaagcacggcgggatgctggtccggaaccccctgagccgcaactccacccacgagatgtactgggtgagctgcggcaccgggaacatcgtgtccgccgtcaacatgacgagccggatgctcctgaaccgcttcaccatggcgcaccgcaagcccaccttcgagcgggacgtggacctgggcgccggcacccgccacgtggccgtcgagcccgaggtggccaacctcgacatcatcgggcagcggatcgagaacatcaagaacgagcacaagtccacgtggcactacgacgaggacaacccgtacaagacctgggcctaccacggcagctacgaggtgaagccctccgggagcgcgtccagcatggtcaacggcgtggtgcgcctgctgaccaagccctgggacgtcatccccatggtgacccagatcgccatgacggacaccaccccgttcgggcagcagcgggtcttcaaggagaaggtggacacccgcacgccccgggccaagcgcggcaccacccagatcatggaggtgaccgccaagtggctctggggcttcctgtcccggaacaagaagccccgcatctgcacgcgggaggagttcacccgcaaggtccggagcaacgccgcgatcggggccgtgttcgtggacgagaaccagtggaacagcgccaaggaggccgtcgaggacgagcgcttctgggacctggtgcaccgggagcgcgagctccacaagcagggcaagtgcgcgacctgcgtgtacaacatgatggggaagcgggagaagaagctgggcgagttcgggaaggccaagggctcccgcgccatctggtacatgtggctgggcgcccggttcctcgagttcgaggccctggggttcatgaacgaggaccactggttcagccgcgagaactccctgagcggcgtcgagggggagggcctccacaagctggggtacatcctgcgggacatctccaagatcccgggcggcaacatgtacgcggacgacaccgccgggtgggacacgcgcatcaccgaggacgacctccagaacgaggccaagatcaccgacatcatggagcccgagcacgccctgctggccaccagcatcttcaagctcacgtaccagaacaaggtggtgcgcgtccagcggcccgcgaagaacggcaccgtgatggacgtgatctcccgccgggaccagcgcgggagcggccaggtcggcacctacgggctgaacaccttcacgaacatggaggtgcagctgatccggcagatggagtccgagggcatcttcctccccagcgagctggagaccccgaacctggccgagcgcgtgctcgactggctggagaagcacggggccgagcggctgaagcgcatggccatctccggcgacgactgcgtcgtgaagcccatcgacgaccggttcgccaccgcgctcaccgccctgaacgacatggggaaggtgcgcaaggacatcccccagtgggagcccagcaagggctggaacgactggcagcaggtcccgttctgctcccaccacttccaccagctgatcatgaaggacggccgggagatcgtggtgccctgccgcaaccaggacgagctcgtcgggcgggcccgcgtgagccagggcgccgggtggtccctgcgggagaccgcctgcctgggcaagagctacgcgcagatgtggcagctcatgtacttccaccgccgggacctgcgcctggccgccaacgccatctgctccgcggtgcccgtcgactgggtgcccacgagccggaccacctggagcatccacgcccaccaccagtggatgaccacggaggacatgctctccgtgtggaaccgcgtctggatcgaggagaacccgtggatggaggacaagacccacgtgagctcctgggaggaggtgccctacctggggaagcgcgaggaccagtggtgcggcagcctgatcggcctcaccgcccgggccacctgggccacgaacatccaggtcgcgatcaaccaggtgcgccggctgatcgggaacgagaactacctggactacatgacctccatgaagcgcttcaagaacgagagcgaccccgagggcgccctctggtga

SEQ ID NO: 8065 - RNA, 9879 nt, synthetic construct
  misc_feature 1..9879: note = derived and/or modified CDS sequence (opt1) from DENV-1__GQ868501__SS-prME
  source 1..9879: mol_type = other RNA
agcgtgaccatgctgctcatgctgctgcccaccgccctcgccttccacctgacgacccggggcggggagccccacatgatcgtgagcaagcaggagcggggcaagagcctcctgttcaagaccagcgccggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtgggcctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaaccagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaagaccgccgaggtcagctgggagcaggaggccgagcactccggcaccagccacaacatcctggtggaggtgcaggacgacgggaccatgaagatcaaggacgaggagcgcgacgacacgctcaccatcctgctgaaggccaccctcctggccgtctccggcgtgtaccccatgagcatccccgcgaccctgttcgtgtggtacttctggcagaagaagaagcagcggtccggggtcctctgggacacgcccagcccgcccgaggtggagcgcgccgtgctggacgacggcatctaccggatcctgcagcgcggcctgctcgggcggtcccaggtcggcgtgggggtgttccaggacggcgtcttccacaccatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgccgtcgagcccgggaagaacccgaagaacgtgcagacgacccccggcaccttcaagacccccgagggcgaggtgggggcgatcgccctggacttcaagcccggcacgagcgggtccccgatcgtcaaccgggagggcaagatcgtgggcctgtacgggaacggcgtggtcaccaccagcgggacctacgtgtccgccatcgcccaggccaaggcgagccaggagggccccctccccgagatcgaggacgaggtgttcaagaagcgcaacctgacgatcatggacctgcacccggggagcggcaagacccggcgctacctccccgccatcgtccgggaggccatcaagcgcaagctgcggaccctgatcctcgcccccacccgcgtggtggcgtccgagatggccgaggccctgaagggcatgcccatccgctaccagacgaccgccgtcaagagcgagcacaccgggcgggagatcgtggacctgatgtgccacgccaccttcacgatgcgcctcctgtccccggtgcgggtccccaactacaacatgatcatcatggacgaggcgcacttcaccgaccccgccagcatcgccgcccgcggctacatctccacccgggtggggatgggcgaggccgcggccatcttcatgaccgccacgcccccggggagcgtggaggccttcccccagtccaacgccgtcatccaggacgaggagcgcgacatccccgagcggagctggaactccggctacgactggatcaccgacttccccggcaagaccgtgtggttcgtgccgagcatcaagtccgggaacgacatcgcgaactgcctgcgcaagaacggcaagcgggtcatccagctcagccgcaagaccttcgacacggagtaccagaagaccaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgccgggccgatgcccgtcacggtggcgagcgccgcccagcgccggggccgcatcggccggaaccagaacaaggagggggaccagtacgtgtacatgggccagcccctgaacaacgacgaggaccacgcccactggaccgaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcctccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcgcggacgtactccgacccgctcgccctgcgcgagttcaaggagttcgccgccgggcggcgcagcgtcagcggcgacctgatcctcgagatcggcaagctgccccagcacctgaccctccgggcccagaacgcgctggacaacctggtgatgctccacaactccgagcagggcgggaaggcctaccgccacgccatggaggagctgcccgacaccatcgagaccctgatgctcctggccctgatcgcggtgctcaccggcggggtcaccctgttcttcctgagcgggaaggggctcggcaagacctccatcgggctgctgtgcgtgaccgccagctccgccctcctgtggatggccagcgtggagccccactggatcgccgcgtccatcatcctggagttcttcctcatggtcctgctgatcccggagcccgaccggcagcgcacgccccaggacaaccagctcgcctacgtggtgatcggcctgctgttcatgatcctcaccgtcgccgccaacgagatggggctgctggagaccaccaagaaggacctcggcatcgggcacgtggccgcggagaaccaccagcacgccacgatgctggacgtggacctgcggccggccagcgcctggaccctctacgccgtcgcgaccaccgtgatcacgcccatgatgcgccacaccatcgagaacaccaccgccaacatctccctgacggccatcgccaaccaggccgcgatcctgatgggcctcgacaagggctggcccatcagcaagatggacatcggggtgcccctgctggccctcggctgctactcccaggtcaacccgctgaccctgaccgccgccgtgctcatgctggtggcgcactacgccatcatcgggcccggcctgcaggccaaggccacccgggaggcccagaagcgcacggcggccgggatcatgaagaaccccaccgtcgacggcatcgtggccatcgacctcgaccccgtggtctacgacgccaagttcgagaagcagctgggccagatcatgctgctcatcctgtgcaccagccagatcctgctcatgcgcaccacgtgggccctgtgcgagtccatcaccctggcgaccgggccgctcaccacgctgtgggagggcagccccgggaagttctggaacaccaccatcgccgtgtccatggccaacatcttccggggcagctacctggccggcgccgggctcgcgttctccctgatgaagtccctgggcgggggccgccgggggaccggcgcccagggcgagacgctcggggagaagtggaagcgccagctgaaccagctgtccaagagcgagttcaacacctacaagcggagcggcatcatggaggtggaccgctccgaggccaaggaggggctcaagcggggcgagaccaccaagcacgccgtcagccgcgggaccgcgaagctgcggtggttcgtggagcgcaacctggtgaagcccgagggcaaggtcatcgacctgggctgcgggcggggcgggtggtcctactactgcgccggcctcaagaaggtgacggaggtgaaggggtacaccaagggcggccccgggcacgaggagccgatcctgatggccacctacggctggaacctggtcgagctccacagcgggaaggacgtgttcttcatgccgcccgagaagtgcgacaccctgctgtgcgacatcggcgagtccagccccaacccgacgatcgaggaggggcgcaccctccgggtgctgaagatggtcgagccctggctgcgcggcaaccagttctgcatcaagatcctcaacccctacatgccctccgtggtggagaccctggagcagatgcagcggaagcacggcgggatgctggtccgcaacccgctcagccggaactccacccacgagatgtactgggtgagctgcggcacggggaacatcgtgtccgccgtcaacatgaccagccgcatgctgctgaaccggttcaccatggcccaccgcaagcccaccttcgagcgcgacgtggacctcggcgcgggcacgcggcacgtggccgtcgagcccgaggtggccaacctggacatcatcgggcagcgcatcgagaacatcaagaacgagcacaagtccacctggcactacgacgaggacaacccctacaagacctgggcctaccacggcagctacgaggtgaagccgtccgggagcgcctccagcatggtcaacggcgtggtgcggctgctcaccaagccctgggacgtcatccccatggtgacgcagatcgcgatgaccgacaccacccccttcgggcagcagcgcgtcttcaaggagaaggtggacacgcggaccccgcgcgccaagcggggcaccacccagatcatggaggtgacggccaagtggctgtggggcttcctgtcccgcaacaagaagccccggatctgcacccgcgaggagttcacccggaaggtccgcagcaacgccgccatcggggcggtgttcgtggacgagaaccagtggaacagcgccaaggaggccgtcgaggacgagcggttctgggacctcgtgcaccgcgagcgggagctgcacaagcagggcaagtgcgcgacctgcgtgtacaacatgatggggaagcgcgagaagaagctgggcgagttcgggaaggcgaagggctcccgggccatctggtacatgtggctcggcgcccgcttcctggagttcgaggccctggggttcatgaacgaggaccactggttcagccgggagaactccctcagcggcgtcgagggggagggcctgcacaagctggggtacatcctccgcgacatctccaagatccccggcggcaacatgtacgccgacgacacggcggggtgggacacccggatcaccgaggacgacctgcagaacgaggccaagatcaccgacatcatggagccggagcacgccctgctcgccacgagcatcttcaagctgacctaccagaacaaggtggtgcgcgtccagcgccccgccaagaacggcaccgtgatggacgtgatctcccggcgcgaccagcgggggagcggccaggtcggcacctacgggctgaacacgttcaccaacatggaggtgcagctcatccgccagatggagtccgagggcatcttcctgcccagcgagctggagacccccaacctcgcggagcgggtgctggactggctggagaagcacggggccgagcgcctcaagcggatggccatctccggcgacgactgcgtcgtgaagccgatcgacgaccgcttcgccaccgccctgaccgcgctgaacgacatggggaaggtgcggaaggacatcccccagtgggagcccagcaagggctggaacgactggcagcaggtccccttctgctcccaccacttccaccagctcatcatgaaggacggccgcgagatcgtggtgccgtgccggaaccaggacgagctggtcgggcgcgcccgggtgagccagggcgccgggtggtccctgcgcgagacggcctgcctcggcaagagctacgcccagatgtggcagctgatgtacttccaccggcgcgacctgcggctcgcggccaacgccatctgctccgccgtgcccgtcgactgggtgcccaccagccgcaccacctggagcatccacgcgcaccaccagtggatgacgaccgaggacatgctgtccgtgtggaaccgggtctggatcgaggagaacccctggatggaggacaagacccacgtgagctcctgggaggaggtgccgtacctggggaagcgcgaggaccagtggtgcggcagcctcatcggcctgaccgcccgcgccacgtgggccaccaacatccaggtcgccatcaaccaggtgcggcgcctgatcgggaacgagaactacctcgactacatgacctccatgaagcggttcaagaacgagagcgaccccgagggcgcgctgtggtga

SEQ ID NO: 8066 - RNA, 9879 nt, synthetic construct
  misc_feature 1..9879: note = derived and/or modified CDS sequence (opt1) from DENV-1__HQ166035__SS-prME
  source 1..9879: mol_type = other RNA
agcgtgaccatgctgctcatgctgctgcccaccgccctcgccttccacctgaccacccgcggcggggagccccacatgatcgtgtccaagcaggagcggggcaagagcctcctgttcaagacctccgcgggggtgaacatgtgcaccctgatcgccatggacctgggggagctctgcgaggacaccatgacctacaagtgcccccagatcaccgaggccgagcccgacgacgtggactgctggtgcaacgccaccgacacgtgggtcacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctgttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccggctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccggcaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccgcctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccggctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccggcgcatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgggagctgaagtgcgggtccggcatcttcgtgaccaacgaggtccacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtggtcgtgggggacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacaaccagcgcgcctggaacatctgggaggtggaggactacggcttcgggatcttcacgaccaacatctggctgaagctccgggacagctacacccagatgtgcgaccaccgcctgatgagcgcggccatcaaggactccaaggccgtccacgccgacatgggctactggatcgagagcgagaagaacgagacctggaagctggcccgggcgtccttcatcgaggtgaagacgtgcacctggcccaagagccacaccctctggtccaacggcgtgctggagagcgagatgatcatccccaagatctacgggggcccgatctcccagcacaactaccgccccgggtacttcacccagacggccggcccctggcacctggggaagctcgagctggacttcgacctgtgcgagggcaccaccgtcgtggtggacgagcactgcggcaaccgggggccgagcctccgcaccacgaccgtcaccggcaagatcatccacgagtggtgctgccggtcctgcaccctgccgcccctgcgcttccgcggggaggacggctgctggtacgggatggagatccgccccgtgaaggagaaggaggagaacctcgtgcggagcatggtctccgccggcagcggcgaggtggacagcttctccctggggatcctgtgcgtgagcatcatgatcgaggaggtcatgcgctcccggtggagccgcaagatgctcatgacgggcaccctggccgtgttcctgctcctggtgatggggcagctgacctggaacgacctcatccgcctgtgcatcatggtcggcgccaacgcgtccgaccggatggggatgggcaccacgtacctggccctcatggccaccttcaagatgcgcccgatgttcgccgtgggcctgctgttccggcgcctcaccagccgggaggtgctgctgctcaccatcgggctgtccctggtcgccagcgtggagctccccaactccctggaggagctgggcgacgggctcgcgatgggcatcatgatgctgaagctgctcacggagttccagccccaccagctgtggaccaccctgctcagcctgaccttcatcaagacgaccctgtccctcgactacgcctggaagaccaccgccatggccctgagcatcgtctccctgttccccctctgcctgagcacgacctcccagaagaccacctggctgccggtgctcctgggcagcttcgggtgcaagcccctgaccatgttcctcatcacggagaacaagatctggggccgcaagtcctggcccctgaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgaagatcaaggacgaggagcgggacgacaccctcacgatcctgctgaaggccaccatgctcgccgtgtccggcgtctaccccatgagcatccccgcgacccccttcgtgtggtacttctggcagaagaagaagcagcgcatccgggtgctgtgggacaccccgagcccgcccgaggtcgagcgcgccgtgctggacgacgggatctaccggatcctccagcgcggcctgctgggccggagccaggtgggggtcggcgtgttccaggacggggtgttccacacgatgtggcacgtcacccgcggcgccgtgctgatgtaccaggggaagcggctcgagccctcctgggccagcgtgaagaaggacctgatctcctacggcggcgggtggcgcttccagggcagctggaacaccggggaggaggtccaggtgatcgccgtggagccgggcaagaaccccaagaacgtccagaccacgcccgggaccttcaagacccccgagggcgaggtgggcgcgatcgccctggacttcaagccggggacctccggcagccccatcgtgaaccgggaggagaagatcgtcgggctctacggcaacggcgtggtgacgacctccgggacctacgtcagcgccatcgcccaggccaaggcgtcccaggagggccccctgccggagatcgaggacgaggtgttcaagaagcgcaacctgaccatcatggacctccaccccgggagcggcaagacgcggcgctacctgcccgccatcgtgcgggaggccatcaagcgcaagctgcgcaccctcatcctggcccccacccgggtcgtggcgagcgagatggccgaggccctgaaggggatgccgatccgctaccagaccacggccgtgaagtccgagcacaccggccgggagatcgtcgacctcatgtgccacgccaccttcaccatgcgcctgctgagccccgtgcgggtgcccaactacaacatgatcatcatggacgaggcgcacttcacggaccccgcctccatcgccgcccgcggctacatcagcacccgggtcgggatgggcgaggccgcggccatcttcatgaccgccaccccgcccgggtccgtggaggccttcccccagagcaacgccgtgatccaggacgaggagcgcgacatccccgagcggtcctggaacagcggctacgactggatcacggacttcccggggaagaccgtctggttcgtgccctccatcaagagcggcaacgacatcgcgaactgcctccgcaagaacggcaagcgggtgatccagctgtcccgcaagaccttcgacaccgagtaccagaagacgaagaacaacgactgggactacgtcgtgaccaccgacatcagcgagatgggggccaacttccgggccgaccgcgtgatcgacccccggcgctgcctgaagcccgtcatcctcaaggacggcccggagcgggtgatcctggccgggcccatgcccgtgaccgtcgcgtccgccgcccagcgccggggccgcatcgggcgcaaccagaacaaggagggcgaccagtacgtgtacatgggccagcccctgaacaacgacgaggaccacgcccactggacggaggccaagatgctcctggacaacatcaacaccccggaggggatcatccccgcgctgttcgagcccgagcgggagaagtccgccgccatcgacggcgagtaccgcctccgcggggaggcccgcaagaccttcgtcgagctgatgcggcgcggcgacctgcccgtgtggctctcctacaaggtggccagcgaggggttccagtactccgaccggcgctggtgcttcgacggcgagcggaacaaccaggtcctggaggagaacatggacgtggagatctggaccaaggagggcgagcgcaagaagctgcggccgcgctggctcgacgcgcggacctacagcgaccccctggccctgcgcgagttcaaggagttcgccgccgggcggcgctccgtgagcggcgacctcatcctggagatcgggaagctgccccagcacctcacgctgcgggcccagaacgcgctggacaacctcgtcatgctgcacaacagcgagcagggcggcaaggcctaccgccacgccatggaggagctgcccgacaccatcgagaccctcatgctgctggccctcatcgcggtgctgaccgggggcgtgacgctgttcttcctctccgggaagggcctggggaagaccagcatcggcctgctctgcgtcaccgcctccagcgccctgctgtggatggcctccgtggagccgcactggatcgccgcgagcatcatcctcgagttcttcctgatggtgctgctcatccccgagcccgaccggcagcgcaccccgcaggacaaccagctggcctacgtcgtgatcggcctcctcttcatgatcctgacggtggccgccaacgagatggggctgctcgagaccaccaagaaggacctgggcatcgggcacgtcgccgcggagaaccaccagcacgccaccatgctggacgtggacctccggcccgcctccgcctggacgctgtacgccgtggcgaccaccgtcatcacccccatgatgcgccacacgatcgagaacaccaccgccaacatcagcctgaccgccatcgccaaccaggccgcgatcctcatgggcctggacaaggggtggcccatctccaagatggacatcggcgtgccgctgctcgccctgggctgctacagccaggtgaaccccctgacgctcaccgccgccgtcctgatgctggtggcgcactacgccatcatcgggcccggcctccaggccaaggccacccgcgaggcccagaagcggaccgcggccgggatcatgaagaaccccacggtggacggcatcgtcgccatcgacctggacccggtggtgtacgacgccaagttcgagaagcagctggggcagatcatgctcctgatcctgtgcacctcccagatcctcctgatgcgcaccacctgggccctgtgcgagagcatcacgctcgcgaccggccccctgaccaccctgtgggagggctcccccgggaagttctggaacacgaccatcgccgtcagcatggccaacatcttccggggctcctacctcgccggggccggcctggcgttcagcctgatgaagtccctcggcgggggccgccgggggaccggcgcccagggggagaccctgggcgagaagtggaagcgccagctgaaccagctcagcaagtccgagttcaacacgtacaagcggagcggcatcatggaggtggaccgcagcgaggccaaggaggggctgaagcggggcgagaccaccaagcacgccgtgtcccgcgggaccgcgaagctgcggtggttcgtcgagcgcaacctcgtgaagcccgagggcaaggtgatcgacctggggtgcggccggggcgggtggagctactactgcgccggcctgaagaaggtcaccgaggtgaaggggtacacgaagggcgggccgggccacgaggagcccatccccatggccacctacggctggaacctggtgaagctccactccgggaaggacgtcttcttcatgcccccggagaagtgcgacaccctgctgtgcgacatcggcgagagctcccccaaccccaccatcgaggaggggcgcacgctccgggtgctgaagatggtggagccctggctgcgcggcaaccagttctgcatcaagatcctcaacccgtacatgcccagcgtcgtggaggccctggagcagatgcagcggaagcacgggggcatgctggtgcgcaaccccctctcccggaacagcacccacgagatgtactgggtctcctgcggcaccgggaacatcgtgagcgccgtgaacatgacctcccgcatgctgctgaaccgcttcacgatggcgcaccggaagcccacctacgagcgcgacgtcgacctcggcgccgggacccggcacgtggccgtggagccggaggtcgccaacctggacatcatcggccagcgcatcgagaacatcaagaacgagcacaagagcacctggcactacgacgaggacaacccctacaagacgtgggcctaccacggctcctacgaggtgaagcccagcgggtccgcgagctccatggtgaacggcgtcgtgcggctgctcaccaagccctgggacgtcatcccgatggtgacccagatcgccatgaccgacacgacccccttcgggcagcagcgcgtgttcaaggagaaggtcgacacccggacgccccgggccaagcggggcacgacccagatcatggaggtgaccgccaagtggctgtgggggttcctgagccgcaacaagaagccgcggatctgcacccgcgaggagttcacgcggaaggtgcgctccaacgccgcgatcggcgccgtcttcgtggacgagaaccagtggaacagcgccaaggaggccgtggaggacgagcggttctgggacctcgtccaccgcgagcgggagctgcacaagcagggcaagtgcgcgacctgcgtgtacaacatgatggggaagcgcgagaagaagctgggcgagttcgggaaggccaagggcagccgggccatctggtacatgtggctcggggcccgcttcctggagttcgaggccctgggcttcatgaacgaggaccactggttctcccgggagaacagcctctccggcgtggagggggagggcctgcacaagctggggtacatcctccgcgacatcagcaagatccccggcgggaacatgtacgcggacgacaccgccggctgggacacccgcatcacggaggacgacctgcagaacgaggccaagatcaccgagatcatggagcccgagcacgccctgctcgccacctccatcttcaagctgacctaccagaacaaggtcgtgcgggtgcagcgccccgcgaagaacggcacggtcatggacgtgatcagccggcgcgaccagcgggggtccggccaggtggggacctacggcctgaacaccttcaccaacatggaggtccagctcatccgccagatggagagcgagggcatcttcctgccgtccgagctggagacgcccaacctcgccgagcgggtgctggactggctggagaagcacggggccgagcgcctcaagcggatggccatcagcggcgacgactgcgtggtcaagcccatcgacgaccgcttcgccaccgcgctgaccgccctgaacgacatggggaaggtgcggaaggacatcccccagtgggagccgtccaagggctggaacgactggcagcaggtccccttctgcagccaccacttccaccagctcatcatgaaggacgggcgcgagatcgtcgtgccctgccggaaccaggacgagctggtgggccgcgcccgggtctcccagggcgccgggtggagcctgcgcgagaccgcctgcctcggcaagtcctacgcgcagatgtggcagctgatgtacttccaccggcgcgacctgcggctcgccgccaacgccatctgcagcgcggtgcccgtggactgggtcccgacctcccgcacgacctggagcatccacgcccaccaccagtggatgaccaccgaggacatgctgagcgtgtggaaccgcgtgtggatcgaggagaacccctggatggaggacaagacgcacgtctccagctgggaggaggtgccctacctggggaagcgggaggaccagtggtgcggctccctcatcgggctgaccgcccgcgccacctgggccaccaacatccaggtggcgatcaaccaggtccggcgcctgatcggcaacgagaactacctcgactacatgacgagcatgaagcggttcaagaacgagtccgaccccgagggcgccctgtggtga

SEQ ID NO: 8067 - RNA, 9879 nt, synthetic construct
  misc_feature 1..9879: note = derived and/or modified CDS sequence (opt1) from DENV-1__GQ868502__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggaccatcttcatcctgctgatgctcgccacgccctccatggccatgcgctgcgtgggcatcggcaaccgggacttcgtcgaggggctgagcggcgccacctgggtggacgtggtcctggagcacgggtcctgcgtgaccaccatggcgaagaacaagcccacgctcgacatcgagctgctgaagaccgaggtgaccaaccccgccatcctccgcaagctgtgcatcgaggccaagatcagcaacaccacgaccgactcccggtgcccgacccagggcgaggccaccctggtcgaggagcaggacgccaacttcgtgtgccgccggacgttcgtggaccgcggctgggggaacggctgcggcctcttcggcaaggggagcctgctgacctgcgcgaagttcaagtgcgtcaccaagctcgagggcaagaccgtgcagtacgagaacctgaagtactccgtgatcgtcacggtgcacaccggcgaccagcaccaggtggggaacgagaccaccgagcacggcaccatcgccacgatcacgccccaggcccccaccagcgagatccagctgaccgactacggggccctcacgctggactgcagcccccggaccggcctggacttcaacgagatggtcctcctgaccatgaaggagaagtcctggctggtgcacaagcagtggttcctcgacctgccgctgccctggacctccggggccagcacgagccaggagacctggaaccgccaggacctcctggtcaccttcaagaccgcgcacgccaagaagcaggaggtggtggtcctgggctcccaggagggcgccatgcacacggccctcaccggggccaccgagatccagaccagcggcacgaccaccatcttcgcggggcacctgaagtgccggctgaagatggacaagctcaccctgaagggcacgtcctacgtgatgtgcaccgggagcttcaagctggagaaggaggtggccgagacccagcacggcaccgtcctggtccaggtgaagtacgagggcacggacgccccctgcaagatccccttctccacccaggacgagaagggggtcacccagaacggccgcctcatcaccgccaacccgatcgtgacggacaaggagaagcccgtgaacatcgagaccgagccgcccttcggggagagctacatcgtcgtgggcgcgggcgagaaggccctgaagctgtcctggttcaagaaggggagctccatcggcaagatgttcgaggccaccgcccgcggggcccgccggatggcgatcctcggcgacaccgcctgggacttcgggagcatcggcggcgtgttcacgtccgtcgggaagctggtgcaccaggtgttcggcaccgcctacggggtcctgttcagcggcgtgtcctggaccatgaagatcgggatcggcatcctcctgacctggctgggcctcaacagccgctccacgagcctgtccatgacctgcatcgccgtggggatggtcaccctgtacctcggcgtgatggtgcaggccgacagcgggtgcgtcatcaactggaagggccgcgagctgaagtgcgggtccggcatcttcgtgaccaacgaggtgcacacctggacggagcagtacaagttccaggcggacagcccgaagcggctgagcgccgccatcggcaaggcctgggaggagggggtctgcggcatccgctccgccacccggctcgagaacatcatgtggaagcagatcagcaacgagctgaaccacatcctgctcgagaacgacatgaagttcaccgtggtggtcggggacgcgaacggcatcctggcccaggggaagaagatgatccgcccccagcccatggagcacaagtactcctggaagtcctggggcaaggccaagatcatcggcgccgacatccagaacaccacgttcatcatcgacgggcccgacaccccggagtgccccgacaaccagcgggcgtggaacatctgggaggtggaggactacggcttcgggatcttcaccaccaacatctggctgaagctccgcgactcctacacgcagatgtgcgaccaccggctgatgagcgccgccatcaaggactccaaggccgtgcacgccgacatgggctactggatcgagagcgagaagaacgagacctggaagctggcgcgcgcctccttcatcgaggtcaagacctgcacctggcccaagagccacacgctctggtccaacggcgtgctggagagcgagatgatcatccccaagatctacgggggcccgatctcccagcacaactaccggcccgggtacttcacccagaccgccggcccctggcacctggggaagctcgagctggacttcgacctgtgcgagggcaccacggtggtcgtggacgagcactgcggcaaccgcgggccgagcctccggaccaccaccgtgacgggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggatcctgtgcgccagcatcatgatcgaggaggtgatgcggtcccgctggagccggaagatgctcatgaccggcaccctggcggtgttcctgctcctggtcatggggcagctgacgtggaacgacctcatccgcctgtgcatcatggtgggcgccaacgcctccgaccgcatggggatgggcaccacctacctggccctcatggccaccttcaagatgcggccgatgttcgcggtggggctgctgttccgccggctcacgagccgcgaggtcctgctgctcaccatcgggctgtccctggtggccagcgtggagctccccaactccctggaggagctgggcgacgggctcgccatgggcatcatgatgctgaagctgctcaccgagttccagccccaccagctgtggaccacgctgctcagcctgaccttcatcaagaccaccctgtccctcgactacgcctggaagacgaccgcgatggccctgagcatcgtctccctgttccccctctgcctgagcaccacctcccagaagaccacgtggctgccggtgctcctgggcagcttcgggtgcaagcccctgaccatgttcctcatcaccgagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcgtgctacgtgatcagcgggtccagcgccgacctctccctggagaaggccgccgaggtcagctgggagcaggaggccgagcactccggcaccagccacaacatcctggtggaggtgcaggacgacgggacgatgaagatcaaggacgaggagcgcgacgacaccctcaccatcctgctgaaggcgaccctcctggccgtctccggcgtgtaccccatgagcatccccgccacgctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacaccatgtggcacgtgacccgcggggccgtgctgatgtaccagggcaagcggctggagcccagctgggcgtccgtcaagaaggacctcatcagctacggcgggggctggcgcttccaggggtcctggaacacgggcgaggaggtccaggtgatcgccgtcgagcccgggaagaacccgaagaacgtgcagaccacccccggcaccttcaagacgcccgagggcgaggtgggggccatcgccctggacttcaagcccggcaccagcgggtccccgatcgtcaaccgggagggcaagatcgtgggcctgtacgggaacggcgtggtcaccaccagcgggacgtacgtgtccgccatcgcgcaggccaaggccagccaggagggccccctccccgagatcgaggacgaggtgttcaagaagcgcaacctgaccatcatggacctgcacccggggagcggcaagacccggcgctacctccccgccatggtccgggaggcgatcaagcgcaagctgcggaccctgatcctcgcccccacgcgcgtggtggcctccgagatggccgaggccctgaagggcatgcccatccgctaccagaccaccgcggtcaagagcgagcacaccgggcgggagatcgtggacctgatgtgccacgccacgttcaccatgcgcctcctgtccccggtgcgggtccccaactacaacatgatcatcatggacgaggcccacttcaccgaccccgccagcatcgccgcgcgcggctacatctccacccgggtggggatgggcgaggccgccgccatcttcatgacggccacgccgcccgggagcgtggaggcgttcccccagtccaacgccgtcatccaggacgaggagcgcgacatccccgagcggagctggaactccggctacgactggatcaccgacttccccggcaagaccgtgtggttcgtgcccagcatcaagtccgggaacgacatcgccaactgcctgcgcaagaacggcaagcgggtcatccagctcagccgcaagacgttcgacaccgagtaccagaagaccaagaacaacgactgggactacgtggtgaccacggacatctccgagatgggggccaacttccgggcggaccgcgtcatcgacccccggcgctgcctgaagcccgtgatcctgaaggacggccccgagcgggtgatcctcgccgggccgatgcccgtcaccgtggccagcgccgcccagcgccggggccgcatcggccggaaccagaacaaggagggggaccagtacgtgtacatgggccagcccctgaacaacgacgaggaccacgcgcactggaccgaggccaagatgctgctcgacaacatcaacacccccgaggggatcatcccggccctgttcgagcccgagcgcgagaagtccgccgccatcgacggcgagtaccgcctgcgcggggaggcgcgcaagaccttcgtcgagctcatgcggcgcggcgacctgcccgtgtggctgagctacaaggtcgcctccgagggcttccagtacagcgaccggcgctggtgcttcgacggggagcggaacaaccaggtgctcgaggagaacatggacgtggagatctggacgaaggagggcgagcgcaagaagctgcggccccgctggctggacgcccggacctactccgacccgctcgccctgcgcgagttcaaggagttcgccgcggggcggcgcagcgtcagcggcgacctgatcctcgagatcggcaagctgccccagcacctgaccctccgggcccagaacgccctggacaacctggtgatgctccacaactccgagcagggcgggaaggcctaccgccacgcgatggaggagctgcccgacaccatcgagacgctgatgctcctggccctgatcgccgtgctcaccgggggcgtcaccctgttcttcctgagcgggaagggcctcggcaagacctccatcgggctgctgtgcgtgacggccagctccgccctcctgtggatggcgagcgtggagccccactggatcgccgcctccatcatcctggagttcttcctcatggtcctgctgatcccggagcccgaccggcagcgcacgccccaggacaaccagctcgcctacgtggtgatcggcctgctgttcatgatcctcaccgtcgccgcgaacgagatggggctgctggagaccacgaagaaggacctcggcatcgggcacgtggccgccgagaaccaccagcacgccaccatgctggacgtggacctgcggccggccagcgcgtggaccctctacgccgtcgccaccacggtgatcacccccatgatgcgccacaccatcgagaacaccacggccaacatctccctgaccgccatcgcgaaccaggccgccatcctgatgggcctcgacaagggctggcccatcagcaagatggacatcggggtgcccctgctggccctcggctgctactcccaggtcaacccgctgaccctgaccgcggccgtgctcatgctggtggcccactacgccatcatcgggcccggcctgcaggccaaggcgacgcgggaggcccagaagcgcaccgccgccgggatcatgaagaaccccaccgtcgacggcatcgtggccatcgacctcgaccccgtggtctacgacgcgaagttcgagaagcagctgggccagatcatgctgctcatcctgtgcaccagccagatcctgctcatgcgcacgacctgggccctgtgcgagtccatcaccctggccaccgggccgctcacgaccctgtgggagggcagccccgggaagttctggaacaccaccatcgccgtgtccatggccaacatcttccggggcagctacctggcgggcgccgggctcgccttctccctgatgaagtccctgggcgggggccgccgggggacgggcgcccagggcgagaccctcggggagaagtggaagcgccagctgaaccagctgtccaagagcgagttcaacacctacaagcggagcggcatcatggaggtggaccgctccgaggcgaaggaggggctcaagcggggcgagaccaccaagcacgccgtcagccgcgggacggccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacaccaagggcggccccgggcacgaggagccgatccccatggccacctacggctggaacctggtcaagctgcacagcgggaaggacgtgttcttcatgccgcccgagaagtgcgacacgctcctgtgcgacatcggcgagtccagcccgaaccccaccatcgaggaggggcgcaccctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacgcacgagatgtactgggtgagctgcggcaccgggaacatcgtgtccgcggtcaacatgaccagccgcatgctcctgaaccggttcaccatggcccaccgcaagcccacgtacgagcgcgacgtggacctgggcgccggcacccggcacgtggccgtcgagcccgaggtggccaacctcgacatcatcgggcagcgcatcgagaacatcaagaacgagcacaagtccacctggcactacgacgaggacaacccgtacaagacctgggcgtaccacggcagctacgaggtgaagccctccgggagcgcctccagcatggtcaacggcgtggtgcggctgctgacgaagccctgggacgtcatccccatggtgacccagatcgccatgaccgacaccacgccgttcgggcagcagcgcgtcttcaaggagaaggtggacacccggacgccccgggccaagcggggcaccacgcagatcatggaggtgaccgccaagtggctctggggcttcctgtcccgcaacaagaagccccggatctgcacccgcgaggagttcacccggaaggtccgcagcaacgcggccatcggggccgtgttcgtggacgagaaccagtggaacagcgccaaggaggcggtcgaggacgagcggttctgggacctggtgcaccgcgagcgggagctccacaagcagggcaagtgcgccacgtgcgtgtacaacatgatggggaagcgcgagaagaagctgggcgagttcgggaaggccaagggctcccgggccatctggtacatgtggctgggcgcccgcttcctcgagttcgaggcgctggggttcatgaacgaggaccactggttcagccgggagaactccctgagcggcgtcgagggggagggcctccacaagctggggtacatcctgcgcgacatctccaagatcccgggcggcaacatgtacgccgacgacaccgccgggtgggacacccggatcaccgaggacgacctccagaacgaggccaagatcacggagatcatggagcccgagcacgccctgctggcgaccagcatcttcaagctcacctaccagaacaaggtggtgcgcgtccagcgccccgccaagaacggcaccgtgatggacgtgatctcccggcgcgaccagcgggggagcggccaggtcggcacgtacgggctgaacaccttcaccaacatggaggtgcagctgatccgccagatggagtccgagggcatcttcctccccagcgagctggagaccccgaacctggccgagcgggtgctcgactggctggagaagcacggggccgagcgcctgaagcggatggccatctccggcgacgactgcgtcgtgaagcccatcgacgaccgcttcgcgaccgccctcacggccctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagaccgcgtgcctgggcaagagctacgcccagatgtggcagctcatgtacttccaccggcgcgacctgcggctggccgccaacgcgatctgctccgccgtgcccgtcgactgggtgcccaccagccgcaccacgtggagcatccacgcccaccaccagtggatgaccaccgaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcacggcccgcgccacctgggcgaccaacatccaggtcgccatcaaccaggtgcggcgcctgatcgggaacgagaactacctggactacatgacctccatgaagcggttcaagaacgagagcgaccccgagggcgccctctggtga

SEQ ID NO: 8068 - RNA, 9879 nt, synthetic construct
  misc_feature 1..9879: note = derived and/or modified CDS sequence (opt1) from DENV-1__GQ868503__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccagaacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggagcgcgcctccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgccaacgcgtccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggccagcgtggagctccccaactccctggaggagctgggcgacgggctcgcgatgggcatcatgatgctgaagctgctcacggagttccagccccaccagctgtggaccaccctgctcagcctgaccttcatcaagacgaccctgtccctcgactacgcctggaagaccaccgccatggccctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtcagcatcctgctctccagcctgctgaagaacgacgtgcccctcgccgggccgctgatcgccggcggcatgctgatcgcctgctacgtgatcagcgggtccagcgccgacctctccctggagaaggcggccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggccgtctccggcgtgtaccccatgagcatccccgcgaccctgttcgtgtggtacttctggcagaagcggaagcagcgctccggggtcctctgggacacccccagcccgcccgaggtggagcgggccgtgctggacgacggcatctaccgcatcctgcagcggggcctgctcgggcgctcccaggtcggcgtgggggtgttccaggacggcgtcttccacacgatgtggcacgtgacccgcggggccgtgctgatgtaccagggcaagcgcctggagcccagctgggcctccgtcaagaaggacctcatcagctacggcgggggctggcggttccaggggtcctggaacaccggcgaggaggtccaggtgatcgccgtcgagcccgggaagaacccgaagaacgtgcagaccacgcccggcatcttcaagacccccgagggcgaggtgggggcgatcgccctggacttcaagcccggcaccagcgggtccccgatcgtcaaccgcgagggcaagatcgtgggcctgtacgggaacggcgtggtcaccacgagcgggacctacgtgtccgccatcgcccaggccaaggcgagccaggagggccccctccccgagatcgaggacgaggtgttcaagaagcggaacctgaccatcatggacctgcacccggggagcggcaagacccgccggtacctccccgccatcgtccgcgaggccatcaagcggaagctgcgcacgctgatcctcgcccccacccgcgtggtggcgtccgagatggccgaggccctgaagggcatgcccatccggtaccagaccaccgccgtcaagagcgagcacacggggcgcgagatcgtggacctgatgtgccacgccaccttcaccatgcggctcctgtccccggtgcgcgtccccaactacaacatgatcatcatggacgaggcgcacttcaccgaccccgccagcatcgccgcccggggctacatctccacgcgcgtggggatgggcgaggccgcggccatcttcatgaccgccacgccgcccgggagcgtggaggccttcccccagtccaacgccgtcatccaggacgaggagcgggacatccccgagcgcagctggaactccggctacgactggatcaccgacttccccggcaagacggtgtggttcgtgcccagcatcaagtccgggaacgacatcgcgaactgcctgcggaagaacggcaagcgcgtcatccagctcagccggaagaccttcgacaccgagtaccagaagaccaagaacaacgactgggactacgtggtgacgaccgacatctccgagatgggggccaacttccgcgccgaccgggtcatcgacccccgccggtgcctgaagcccgtgatcctgaaggacggccccgagcgcgtgatcctcgccgggccgatgcccgtcaccgtggcgagcgccgcccagcggcgcggccggatcggccgcaaccagaacaaggagggggaccagtacgtgtacatgggccagcccctgaacaacgacgaggaccacgcccactggaccgaggccaagatgctgctcgacaacatcaacacgcccgaggggatcatcccggcgctgttcgagcccgagcgcgagaagtccgccgccatcgacggcgagtaccggctgcgcggggaggcccggaagaccttcgtcgagctcatgcgccggggcgacctgcccgtgtggctgagctacaaggtcgcctccgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcgcgcacctactccgacccgctcgccctgcgggagttcaaggagttcgccgccgggcgccggagcgtcagcggcgacctgatcctcgagatcggcaagctgccccagcacctgaccctccgcgcccagaacgcgctggacaacctggtgatgctccacaactccgagcagggcgggaaggcctaccggcacgccatggaggagctgcccgacacgatcgagaccctgatgctcctggccctgatcgcggtgctcaccgggggcgtcaccctgttcttcctgagcgggaagggcctcggcaagacgtccatcgggctgctgtgcgtgaccgccagctccgccctcctgtggatggccagcgtggagccccactggatcgccgcgtccatcatcctggagttcttcctcatggtcctgctgatcccggagcccgaccgccagcggacgccccaggacaaccagctcgcctacgtggtgatcggcctgctgttcatgatcctcaccgtcgccgccaacgagatggggctgctggagacgaccaagaaggacctcggcatcgggcacgtggccgcggagaaccaccagcacgccaccatgctggacgtggacctgcgcccggccagcgcctggaccctctacgccgtcgcgacgaccgtgatcacccccatgatgcggcacaccatcgagaacacgaccgccaacatctccctgaccgccatcgccaaccaggccgcgatcctgatgggcctcgacaagggctggcccatcagcaagatggacatcggggtgcccctgctggccctcggctgctactcccaggtcaacccgctgaccctgacggccgccgtgctcatgctggtggcgcactacgccatcatcgggcccggcctgcaggccaaggccacccgcgaggcccagaagcgcaccgcggccgggatcatgaagaaccccaccgtcgacggcatcgtggccatcgacctcgaccccgtggtctacgacgccaagttcgagaagcagctgggccagatcatgctgctcatcctgtgcacgagccagatcctgctcatgcggaccacctgggccctgtgcgagtccatcaccctggcgacggggccgctcaccaccctgtgggagggcagccccgggaagttctggaacaccacgatcgccgtgtccatggccaacatcttccgcggcagctacctggccggcgccgggctcgcgttctccctgatgaagtccctgggcgggggccggcgcgggaccggcgcccagggcgagaccctcggggagaagtggaagcggcagctgaaccagctgtccaagagcgagttcaacacctacaagcgcagcggcatcatggaggtggaccggtccgaggccaaggaggggctcaagcgcggcgagacgaccaagcacgccgtcagccgggggaccgcgaagctgcgctggttcgtggagcggaacctggtgaagcccgagggcaaggtcatcgacctgggctgcgggcgcggcgggtggtcctactactgcgccggcctcaagaaggtgaccgaggtgaaggggtacaccaagggcggccccgggcacgaggagccgatccccatggccacgtacggctggaacctggtcaagctgcacagcgggaaggacgtgttcttcatgccgcccgagaagtgcgacaccctcctgtgcgacatcggcgagtccagcccgaaccccaccatcgaggaggggcggaccctgcgcgtgctcaagatggtcgagccctggctgcggggcaaccagttctgcatcaagatcctgaacccctacatgccgtccgtggtggagacgctcgagcagatgcagcgcaagcacggcgggatgctggtccggaaccccctgagccgcaactccacccacgagatgtactgggtgagctgcggcaccgggaacatcgtgtccgccgtcaacatgaccagccggatgctcctgaaccgcttcacgatggcccaccgcaagcccaccttcgagcgggacgtggacctgggcgcgggcacccgccacgtggccgtcgagcccgaggtggccaacctcgacatcatcgggcagcggatcgagaacatcaagaacgagcacaagtccacctggcactacgacgaggacaacccgtacaagacgtgggcctaccacggcagctacgaggtgaagccctccgggagcgcctccagcatggtcaacggcgtggtgcgcctgctgaccaagccctgggacgtcatccccatggtgacccagatcgcgatgaccgacacgaccccgttcgggcagcagcgggtcttcaaggagaaggtggacacccgcacgccccgggccaagcgcggcacgacccagatcatggaggtgaccgccaagtggctctggggcttcctgtcccggaacaagaagccccgcatctgcacccgggaggagttcacgcgcaaggtccggagcaacgccgccatcggggcggtgttcgtggacgagaaccagtggaacagcgccaaggaggccgtcgaggacgagcgcttctgggacctggtgcaccgggagcgcgagctccacaagcagggcaagtgcgcgacctgcgtgtacaacatgatggggaagcgggagaagaagctgggcgagttcgggaaggcgaagggctcccgcgccatctggtacatgtggctgggcgcccggttcctcgagttcgaggccctggggttcatgaacgaggaccactggttcagccgcgagaactccctgagcggcgtcgagggggagggcctccacaagctggggtacatcctgcgggacatctccaagatcccgggcggcaacatgtacgccgacgacaccgcggggtgggacacccgcatcacggaggacgacctccagaacgaggccaagatcaccgacatcatggagcccgagcacgccctgctggccaccagcatcttcaagctcacctaccagaacaaggtggtgcgcgtccagcggcccgccaagaacggcacggtgatggacgtgatctcccgccgggaccagcgcgggagcggccaggtcggcacctacgggctgaacaccttcaccaacatggaggtgcagctgatccggcagatggagtccgagggcatcttcctccccagcgagctggagacgccgaacctggcggagcgcgtgctcgactggctggagaagcacggggccgagcggctgaagcgcatggccatctccggcgacgactgcgtcgtgaagcccatcgacgaccggttcgccaccgccctcaccgcgctgaacgacatggggaaggtgcgcaaggacatcccccagtgggagcccagcaagggctggaacgactggcagcaggtcccgttctgctcccaccacttccaccagctgatcatgaaggacggccgggagatcgtggtgccctgccgcaaccaggacgagctcgtcgggcgggcccgcgtgagccagggcgccgggtggtccctgcgggagaccgcctgcctgggcaagagctacgcccagatgtggcagctcatgtacttccaccgccgggacctgcgcctggcggccaacgccatctgctccgccgtgcccgtcgactgggtgcccaccagccggacgacctggagcatccacgcgcaccaccagtggatgaccaccgaggacatgctctccgtgtggaaccgcgtctggatcgaggagaacccgtggatggaggacaagacgcacgtgagctcctgggaggaggtgccctacctggggaagcgcgaggaccagtggtgcggcagcctgatcggcctcaccgcccgggccacctgggccaccaacatccaggtcgccatcaaccaggtgcgccggctgatcgggaacgagaactacctggactacatgacgtccatgaagcgcttcaagaacgagagcgaccccgagggcgcgctctggtga

SEQ ID NO: 8069 - RNA, 9879 nt, synthetic construct
  misc_feature 1..9879: note = derived and/or modified CDS sequence (opt1) from DENV-1__GQ868504__SS-prME
  source 1..9879: mol_type = other RNA
agcgtgaccatgctgctcatgctgctgcccaccgccctcgccttccacctgaccacccggggcggggagccgcacatgatcgtgagcaagcaggagcggggcaagagcctgctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccgccgggacaagcgctccgtggccctggcgccccacgtgggcctggggctcgagacgcggaccgagacctggatgagcagcgagggcgcctggaagcagatccagcgggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgtgagcatcatgatcgaggaggtcatgcggtcccgctggagccggaagatgctcatgacgggcaccctggccgtgttcctgctcctggtgatggggcagctgacctggaacgacctcatccgcctgtgcatcatggtcggcgccaacgcgtccgaccgcatggggatgggcaccacgtacctggccctcatggccaccttcaagatgcggccgatgttcgccgtgggcctgctgttccgccggctcaccagccgcgaggtgctgctgctcaccatcgggctgtccctggtcgccagcgtggagctccccaactccctggaggagctgggcgacgggctcgcgatgggcatcatgatgctgaagctgctcacggagttccagccccaccagctgtggaccaccctgctcagcctgaccttcatcaagacgaccctgtccctcgactacgcctggaagaccaccgccatggccctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggccgtgtccggcgtctaccccatgagcatccccgcgaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcaccagcgggtccccgatcgtgaaccgggagggcaagatcgtcggcctgtacgggaacggcgtggtgacgaccagcgggacctacgtctccgccatcgcccaggccaaggcgagccaggagggccccctccccgagatcgaggacgaggtgttcaagaagcgcaacctgaccatcatggacctgcacccggggagcggcaagacgcggcgctacctccccgccatcgtgcgggaggccatcaagcgcaagctgcggaccctgatcctcgcccccacccgcgtcgtggcgtccgagatggccgaggccctgaagggcatgcccatccgctaccagaccacggccgtgaagggggagcacaccggccgggagatcgtcgacctgatgtgccacgccaccttcaccatgcgcctcctgagcccggtgcgggtgcccaactacaacatgatcatcatggacgaggcgcacttcacggaccccgcctccatcgccgcccgcgggtacatcagcacccgggtcggcatgggggaggccgcggccatcttcatgaccgccacgccgcccggctccgtggaggccttcccccagagcaacgccgtgatccaggacgaggagcgcgacatccccgagcggtcctggaacagcggctacgactggatcacggacttccccgggaagaccgtctggttcgtgccctccatcaagagcggcaacgacatcgcgaactgcctgcgcaagaacgggaagcgggtgatccagctctcccgcaagaccttcgacaccgagtaccagaagacgaagaacaacgactgggactacgtcgtgaccaccgacatcagcgagatgggcgccaacttccgggccgaccgcgtgatcgacccccggcgctgcctgaagcccgtcatcctgaaggacgggcccgagcgggtgatcctcgccggcccgatgcccgtgaccgtcgcgtccgccgcccagcgccggggccgcatcgggcggaaccagaacaaggagggcgaccagtacgtgtacatggggcagcccctgaacaacgacgaggaccacgcccactggacggaggccaagatgctgctcgacaacatcaacacccccgagggcatcatcccggcgctgttcgagcccgagcgcgagaagtccgccgccatcgacggggagtaccgcctgcggggcgaggcccgcaagaccttcgtcgagctcatgcggcgcggcgacctgcccgtgtggctgtcctacaaggtggccagcgaggggttccagtaccccgaccggcgctggtgcttcgacggcgagcggaacaaccaggtcctcgaggagaacatggacgtggagatctggaccaaggagggggagcgcaagaagctgcggccgcgctggctggacgcgcggacctactccgaccccctcgccctgcgcgagttcaaggagttcgccgccggccggcgcagcgtgtccggcgacctgatcctcgagatcgggaagctgccccagcacctgacgctccgggcccagaacgcgctggacaacctggtcatgctccacaacagcgagcagggcgggaaggcctaccgccacgccatggaggagctgcccgacaccatcgagaccctgatgctcctggccctgatcgcggtgctcaccggcggggtgacgctgttcttcctgagcggcaagggcctcgggaagacctccatcggcctgctgtgcgtcaccgccagctccgccctcctgtggatggccagcgtggagccgcactggatcgccgcgtccatcatcctggagttcttcctcatggtgctgctgatccccgagcccgaccggcagcgcaccccgcaggacaaccagctcgcctacgtcgtgatcgggctgctgttcatgatcctcacggtggccgccaacgagatgggcctgctggagaccaccaagaaggacctcgggatcggccacgtcgccgcggagaaccaccagcacgccaccatgctggacgtggacctgcggcccgccagcgcctggacgctctacgccgtggcgaccaccgtcatcacccccatgatgcgccacacgatcgagaacaccaccgccaacatctccctgaccgccatcgccaaccaggccgcgatcctgatgggcctcgacaaggggtggcccatcagcaagatggacatcggcgtgccgctgctggccctcgggtgctactcccaggtgaaccccctgacgctgaccgccgccgtcctcatgctggtggcgcactacgccatcatcggccccgggctgcaggccaaggccacccgggaggcccagaagcgcaccgcggccggcatcatgaagaaccccacggtggacggcatcgtcgccatcgacctcgacccggtggtgtacgacgccaagttcgagaagcagctggggcagatcatgctgctcatcctgtgcaccagccagatcctgctcatgcgcaccacctgggccctgtgcgagtccatcacgctggcgaccggccccctcaccaccctgtgggaggggagccccggcaagttctggaacacgaccatcgccgtctccatggccaacatcttccggggcagctacctggccggggccggcctcgcgttctccctgatgaagtccctcgggggcgggcgccgggggaccggcgcccagggggagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgccgtgagccgcggcaccgcgaagctgcggtggttcgtcgagcgcaacctggtgaagcccgagggcaaggtgatcgacctggggtgcggccgcggcgggtggtcctactactgcgccgggctcaagaaggtcaccgaggtgaaggggtacacgaagggcgggccgggccacgaggagcccatccccatggccacctacgggtggaacctggtgaagctgcacagcggcaaggacgtcttcttcatgcccccggagaagtgcgacaccctcctgtgcgacatcggggagtccagccccaaccccaccatcgaggagggccgcacgctgcgggtgctcaagatggtggagccctggctgcgcggcaaccagttctgcatcaagatcctgaacccgtacatgccctccgtcgtggaggccctcgagcagatgcagcggaagcacgggggcatgctggtgcgcaaccccctgagccggaactccacccacgagatgtactgggtcagctgcgggaccggcaacatcgtgtccgccgtgaacatgaccagccgcatgctcctgaaccggttcacgatggcgcaccgcaagcccacctacgagcgcgacgtcgacctgggcgccgggacccggcacgtggccgtggagccggaggtcgccaacctcgacatcatcggccagcgcatcgagaacatcaagaacgagcacaagtccacctggcactacgacgaggacaacccctacaagacgtgggcctaccacgggagctacgaggtgaagccctccggcagcgcgtccagcatggtgaacggggtcgtgcggctgctgaccaagccctgggacgtcatcccgatggtgacccagatcgccatgaccgacacgacccccttcggccagcagcgcgtgttcaaggagaaggtcgacacccggacgccccgggccaagcggggcacgacccagatcatggaggtgaccgccaagtggctctgggggttcctgtcccgcaacaagaagccgcggatctgcacccgcgaggagttcacgcggaaggtgcgcagcaacgccgcgatcggcgccgtcttcgtggacgagaaccagtggaactccgccaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggccaagggcagccgggccatctggtacatgtggctgggggcccgcttcctcgagttcgaggccctgggcttcatgaacgaggaccactggttcagccgggagaactccctgagcggggtggagggcgaggggctccacaagctgggctacatcctgcgcgacatctccaagatccccggcgggaacatgtacgcggacgacaccgccggctgggacacccggatcacggaggacgacctccagaacgaggccaagatcaccgagatcatggagcccgagcacgccctgctggccaccagcatcttcaagctcacctaccagaacaaggtcgtgcgcgtgcagcgccccgcgaagaacgggacggtcatggacgtgatctcccggcgcgaccagcggggcagcggccaggtggggacctacggcctgaacaccttcaccaacatggaggtccagctgatccgccagatggagtccgaggggatcttcctcccgagcgagctggagacgcccaacctggccgagcgggtgctcgactggctggagaagcacggcgccgagcgcctgaagcggatggccatctccggggacgactgcgtggtcaagcccatcgacgaccgcttcgccaccgcgctcaccgccctgaacgacatgggcaaggtgcggaaggacatcccccagtgggagccgagcaagggctggaacgactggcagcaggtccccttctgctcccaccacttccaccagctgatcatgaaggacgggcgcgagatcgtcgtgccctgccggaaccaggacgagctcgtgggccgcgcccgggtcagccagggggccggctggtccctgcgcgagaccgcctgcctgggcaagagctacgcgcagatgtggcagctcatgtacttccaccggcgcgacctgcggctggccgccaacgccatctgctccgcggtgcccgtggactgggtcccgaccagccgcacgacctggtccatccacgcccaccaccagtggatgaccaccgaggacatgctcagcgtgtggaaccgggtgtggatcgaggagaacccctggatggaggacaagacgcacgtcagctcctgggaggaggtgccctacctgggcaagcgcgaggaccagtggtgcggcagcctgatcgggctcaccgcccgcgccacctgggccaccaacatccaggtggcgatcaaccaggtccggcgcctgatcggcaacgagaactacctggactacatgacgtccatgaagcggttcaagaacgagagcgaccccgagggggccctctggtga

SEQ ID NO: 8070 - RNA, 9879 nt, synthetic construct
  misc_feature 1..9879: note = derived and/or modified CDS sequence (opt1) from DENV-1__GU131967__SS-prME
  source 1..9879: mol_type = other RNA
agcgtgaccatgctgctcatgctgctgcccaccgccctcgccttccacctgacgacccggggcggggagccccacatgatcgtgagcaagcaggagcggggcaagagcctcctgttcaagaccagcgcgggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagacctgcgaccaccggctgatgagcgcggccatcaaggactccaaggccgtccacgccgacatgggctactggatcgagagcgagaagaacgagacgtggaagctggcccgcgcgtccttcatcgaggtgaagacctgcacctggcccaagagccacaccctctggtccaacggcgtgctggagagcgagatgatcatccccaagatctacgggggcccgatctcccagcacaactaccggcccgggtacttcacgcagaccgccggcccctggcacctggggaagctcgagctggacttcgacctgtgcgagggcaccaccgtcgtggtggacgagcactgcggcaaccgcgggccgagcctccggacgaccaccgtcaccggcaagatcatccacgagtggtgctgccgctcctgcacgctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgtgagcatcatgatcgaggaggtcatgcggtcccgctggagccggaagatgctcatgaccggcaccctggccgtgttcctgctcctggtgatggggcagctgacctggaacgacctcatccgcctgtgcatcatggtcggcgccaacgcgtccgaccgcatggggatgggcacgacctacctggccctcatggccaccttcaagatgcggccgatgttcgccgtggggctgctgttccgccggctcaccagccgcgaggtgctgctgctcacgatcgggctgtccctggtcgccagcgtggagctccccaactccctggaggagctgggcgacgggctcgcgatgggcatcatgatgctgaagctgctcaccgagttccagccccaccagctgtggaccaccctgctcagcctgacgttcatcaagaccaccctgtccctcgactacgcctggaagaccacggccatggccctgagcatcgtctccctgttccccctctgcctgagcaccacctcccagaagaccacctggctgccggtgctcctgggcagcttcgggtgcaagcccctgacgatgttcctcatcaccgagaacaagatctggggccggaagtcctggcccctgaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgaagatcaaggacgaggagcgcgacgacacgctcaccatcctgctgaaggccaccctcctggccgtgtccggcgtctaccccatgagcatccccgcgaccctgttcgtgtggtacttctggcagaagaagaagcagcggtccggggtgctctgggacacgcccagcccgcccgaggtcgagcgcgccgtgctggacgacggcatctaccggatcctgcagcgcggcctgctcgggcggtcccaggtgggcgtcggggtgttccaggacggcgtgttccacaccatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagacgacccccggcaccttcaagacccccgagggcgaggtgggggcgatcgccctggacttcaagcccggcacgagcgggtccccgatcgtgaaccgggagggcaagatcgtcggcctgtacgggaacggcgtggtgaccaccagcgggacctacgtctccgccatcgcccaggccaaggcgagccaggagggccccctccccgagatcgaggacgaggtgttcaagaagcgcaacctgacgatcatggacctgcacccggggagcggcaagacccggcgctacctccccgccatcgtgcgggaggccatcaagcgcaagctgcggaccctgatcctcgcccccacccgcgtcgtggcgtccgagatggccgaggccctgaagggcatgcccatccgctaccagacgaccgccgtcaagagcgagcacaccgggcgggagatcgtcgacctgatgtgccacgccaccttcacgatgcgcctcctgtccccggtgcgggtgcccaactacaacatgatcatcatggacgaggcgcacttcaccgaccccgccagcatcgccgcccgcggctacatctccacccgggtcgggatgggcgaggccgcggccatcttcatgaccgccacgcccccggggagcgtggaggccttcccccagtccaacgccgtgatccaggacgaggagcgcgacatccccgagcggagctggaactccggctacgactggatcaccgacttccccggcaagaccgtctggttcgtgccgagcatcaagtccgggaacgacatcgcgaactgcctgcgcaagaacggcaagcgggtgatccagctcagccgcaagaccttcgacacggagtaccagaagaccaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgccgggccgatgcccgtgacggtcgcgagcgccgcccagcgccggggccgcatcggccggaaccagaacaaggagggggaccagtacgtgtacatgggccagcccctgaacaacgacgaggaccacgcccactggaccgaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtggcctccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcgcggacgtactccgacccgctcgccctgcgcgagttcaaggagttcgccgccgggcggcgcagcgtgagcggcgacctgatcctcgagatcggcaagctgccccagcacctgaccctccgggcccagaacgcgctggacaacctggtcatgctccacaactccgagcagggcgggaaggcctaccgccacgccatggaggagctgcccgacaccatcgagaccctgatgctcctggccctgatcgcggtgctcaccggcggggtgaccctgttcttcctgagcgggaaggggctcggcaagacctccatcgggctgctgtgcgtcaccgccagctccgccctcctgtggatggccagcgtggagccccactggatcgccgcgtccatcatcctggagttcttcctcatggtgctgctgatcccggagcccgaccggcagcgcacgccccaggacaaccagctcgcctacgtcgtgatcggcctgctgttcatgatcctcaccgtggccgccaacgagatggggctgctggagaccaccaagaaggacctcggcatcgggcacgtcgccgcggagaaccaccagcacgccacgatgctggacgtggacctgcggccggccagcgcctggaccctctacgccgtggcgaccaccgtcatcacgcccatgatgcgccacaccatcgagaacaccaccgccaacatctccctgacggccatcgccaaccaggccgcgatcctgatgggcctcgacaagggctggcccatcagcaagatggacatcggggtgcccctgctggccctcggctgctactcccaggtgaacccgctgaccctgaccgccgccgtcctcatgctggtggcgcactacgccatcatcgggcccggcctgcaggccaaggccacccgggaggcccagaagcgcacggcggccgggatcatgaagaaccccaccgtggacggcatcgtcgccatcgacctcgaccccgtggtgtacgacgccaagttcgagaagcagctgggccagatcatgctgctcatcctgtgcaccagccagatcctgctcatgcgcaccacgtgggccctgtgcgagtccatcaccctggcgaccgggccgctcaccacgctgtgggagggcagccccgggaagttctggaacaccaccatcgccgtctccatggccaacatcttccggggcagctacctggccggcgccgggctcgcgttctccctgatgaagtccctgggcgggggccgccgggggaccggcgcccagggcgagacgctcggggagaagtggaagcgccagctgaaccagctgtccaagagcgagttcaacacctacaagcggagcggcatcatggaggtggaccgctccgaggccaaggaggggctcaagcggggcgagaccaccaagcacgccgtgagccgcgggaccgcgaagctgcggtggttcgtcgagcgcaacctggtgaagcccgagggcaaggtgatcgacctgggctgcgggcggggcgggtggtcctactactgcgccggcctcaagaaggtcacggaggtgaaggggtacaccaagggcggccccgggcacggcgagccgatccccctggccacctacgggtggaacctggtgaagctccacagcggcaaggacgtcttcttcatgccgcccgagaagtgcgacaccctgctgtgcgacatcggggagtccagcccgaaccccacgatcgaggagggccgcaccctccgggtgctgaagatggtggagccctggctgcgcggcaaccagttctgcatcaagatcctcaacccctacatgccgtccgtcgtggaggccctggagcagatgcagcggaagcacgggggcatgctggtgcgcaaccccctcagccggaactccacccacgagatgtactgggtcagctgcgggaccggcaacatcgtgtccgccgtgaacatgacgagccgcatgctgctgaaccggttcaccatggcgcaccgcaagcccacctacgagcgcgacgtcgacctcggcgccgggacccggcacgtggccgtggagcccgaggtcgccaacctggacatcatcggccagcgcatcgagaacatcaagaacgagcacaagtccacgtggcactacgacgaggacaacccgtacaagacctgggcctaccacgggagctacgaggtgaagccctccggcagcgcgtccagcatggtgaacggggtcgtgcggctgctcaccaagccctgggacgtcatccccatggtgacccagatcgccatgacggacaccaccccgttcggccagcagcgcgtgttcaaggagaaggtcgacacccggacgccccgcgccaagcggggcaccacccagatcatggaggtgaccgccaagtggctgtgggggttcctgtcccgcaacaagaagccccggatctgcacgcgcgaggagttcacccggaaggtgcgcagcaacgccgcgatcggcgccgtcttcgtggacgagaaccagtggaacagcgccaaggaggccgtggaggacgagcggttctgggacctcgtccaccgcgagcgggagctgcacaagcaggggaagtgcgcgacctgcgtgtacaacatgatgggcaagcgcgagaagaagctgggggagttcggcaaggccaagggctcccgggccatctggtacatgtggctcggggcccgcttcctggagttcgaggccctgggcttcatgaacgaggaccactggttcagccgggagaactccctcagcggggtggagggcgaggggctgcacaagctgggctacatcctccgcgacatctccaagatcccgggcgggaacatgtacgcggacgacaccgccggctgggacacgcggatcaccgaggacgacctgcagaacgaggccaagatcaccgagatcatggagcccgagcacgccctgctcgccaccagcatcttcaagctgacgtaccagaacaaggtcgtgcgcgtgcagcgccccgcgaagaacgggaccgtcatggacgtgatctcccggcgcgaccagcggggcagcggccaggtggggacctacggcctgaacaccttcacgaacatggaggtccagctcatccgccagatggagtccgaggggatcttcctgcccagcgagctggagaccccgaacctcgccgagcgggtgctggactggctggagaagcacggcgccgagcgcctcaagcggatggccatctccggggacgactgcgtggtcaagcccatcgacgaccgcttcgccaccgcgctgaccgccctgaacgacatgggcaaggtgcggaaggacatcccccagtgggagcccagcaagggctggaacgactggcagcaggtcccgttctgctcccaccacttccaccagctcatcatgaaggacgggcgcgagatcgtcgtgccctgccggaaccaggacgagctggtgggccgcgcccgggtcagccagggggccggctggtccctgcgcgagaccgcctgcctcggcaagagctacgcgcagatgtggcagctgatgtacttccaccggcgcgacctgcggctcgccgccaacgccatctgctccgcggtgcccgtggactgggtccccacgagccgcaccacctggagcatccacgcccaccaccagtggatgaccacggaggacatgctgtccgtgtggaaccgggtgtggatcgaggagaacccgtggatggaggacaagacccacgtcagctcctgggaggaggtgccctacctgggcaagcgcgaggaccagtggtgcggcagcctcatcgggctgaccgcccgcgccacctgggccacgaacatccaggtggcgatcaaccaggtccggcgcctgatcggcaacgagaactacctcgactacatgacctccatgaagcggttcaagaacgagagcgaccccgagggggccctgtggtga

SEQ ID NO: 8071 - RNA, 9879 nt, synthetic construct
  misc_feature 1..9879: note = derived and/or modified CDS sequence (opt1) from DENV-1__GU131968__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccagaacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggagcgcgcctccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgccaacgcgtccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggccagcgtggagctccccaactccctggaggagctgggcgacgggctcgcgatgggcatcatgatgctgaagctgctcacggagttccagccccaccagctgtggaccaccctgctcagcctgaccttcatcaagacgaccctgtccctcgactacgcctggaagaccaccgccatggccctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtcagcatcctgctctccagcctgctgaagaacgacgtgcccctcgccgggccgctgatcgccggcggcatgctgatcgcctgctacgtgatcagcgggtccagcgccgacctctccctggagaaggcggccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggccgtctccggcgtgtaccccatgagcatccccgcgaccctgttcgtgtggtacttctggcagaagcggaagcagcgctccggggtcctctgggacacccccagcccgcccgaggtggagcgggccgtgctggacgacggcatctaccgcatcctgcagcggggcctgctcgggcgctcccaggtcggcgtgggggtgttccaggacggcgtcttccacacgatgtggcacgtgacccgcggggccgtgctgatgtaccagggcaagcgcctggagcccagctgggcctccgtcaagaaggacctcatcagctacggcgggggctggcggttccaggggtcctggaacaccggcgaggaggtccaggtgatcgccgtcgagcccgggaagaacccgaagaacgtgcagaccacgcccggcaccttcaagacccccgagggcgaggtgggggcgatcgccctggacttcaagcccggcaccagcgggtccccgatcgtcaaccgcgagggcaagatcgtgggcctgtacgggaacggcgtggtcacgaccagcgggacctacgtgtccgccatcgcccaggccaaggcgagccaggagggccccctccccgagatcgaggacgaggtgttcaagaagcggaacctgaccatcatggacctgcacccggggagcggcaagacgcgccggtacctccccgccatcgtccgcgaggccatcaagcggaagctgcgcaccctgatcctcgcccccacccgcgtggtggcgtccgagatggccgaggccctgaagggcatgcccatccggtaccagaccacggccgtcaagagcgagcacaccgggcgcgagatcgtggacctgatgtgccacgccaccttcaccatgcggctcctgtccccggtgcgcgtccccaactacaacatgatcatcatggacgaggcgcacttcacggaccccgccagcatcgccgcccggggctacatctccacccgcgtggggatgggcgaggccgcggccatcttcatgaccgccacgccgcccgggagcgtggaggccttcccccagtccaacgccgtcatccaggacgaggagcgggacatccccgagcgcagctggaactccggctacgactggatcacggacttccccggcaagaccgtgtggttcgtgcccagcatcaagtccgggaacgacatcgcgaactgcctgcggaagaacggcaagcgcgtcatccagctcagccggaagaccttcgacaccgagtaccagaagacgaagaacaacgactgggactacgtggtgaccaccgacatctccgagatgggggccaacttccgcgccgaccgggtcatcgacccccgccggtgcctgaagcccgtgatcctgaaggacggccccgagcgcgtgatcctcgccgggccgatgcccgtcaccgtggcgagcgccgcccagcggcgcggccggatcggccgcaaccagaacaaggagggggaccagtacgtgtacatgggccagcccctgaacaacgacgaggaccacgcccactggacggaggccaagatgctgctcgacaacatcaacacccccgaggggatcatcccggcgctgttcgagcccgagcgcgagaagtccgccgccatcgacggcgagtaccggctgcgcggggaggcccggaagaccttcgtcgagctcatgcgccggggcgacctgcccgtgtggctgagctacaaggtcgcctccgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcgcgcacctactccgacccgctcgccctgcgggagttcaaggagttcgccgccgggcgccggagcgtcagcggcgacctgatcctcgagatcggcaagctgccccagcacctgacgctccgcgcccagaacgcgctggacaacctggtgatgctccacaactccgagcagggcgggaaggcctaccggcacgccatggaggagctgcccgacaccatcgagaccctgatgctcctggccctgatcgcggtgctcaccgggggcgtcacgctgttcttcctgagcgggaagggcctcggcaagacctccatcgggctgctgtgcgtgaccgccagctccgccctcctgtggatggccagcgtggagccccactggatcgccgcgtccatcatcctggagttcttcctcatggtcctgctgatcccggagcccgaccgccagcggacgccccaggacaaccagctcgcctacgtggtgatcggcctgctgttcatgatcctcacggtcgccgccaacgagatggggctgctggagaccaccaagaaggacctcggcatcgggcacgtggccgcggagaaccaccagcacgccaccatgctggacgtggacctgcgcccggccagcgcctggacgctctacgccgtcgcgaccaccgtgatcacccccatgatgcggcacacgatcgagaacaccaccgccaacatctccctgaccgccatcgccaaccaggccgcgatcctgatgggcctcgacaagggctggcccatcagcaagatggacatcggggtgcccctgctggccctcggctgctactcccaggtcaacccgctgacgctgaccgccgccgtgctcatgctggtggcgcactacgccatcatcgggcccggcctgcaggccaaggccacccgcgaggcccagaagcgcaccgcggccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcggaccacctgggccctgtgcgagtccatcacgctggcgaccgggccgctcaccaccctgtgggagggcagccccgggaagttctggaacacgaccatcgccgtgtccatggccaacatcttccgcggcagctacctggccggcgccgggctcgcgttctccctgatgaagtccctgggcgggggccggcgcgggaccggcgcccagggcgagaccctcggggagaagtggaagcggcagctgaaccagctgtccaagagcgagttcaacacgtacaagcgcagcggcatcatggaggtggaccggtccgaggccaaggaggggctcaagcgcggcgagaccaccaagcacgccgtcagccgggggaccgcgaagctgcgctggttcgtggagcggaacctggtgaagcccgagggcaaggtcatcgacctgggctgcgggcgcggcgggtggtcctactactgcgccggcctcaagaaggtgaccgaggtgaaggggtacacgaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccaccatcgaggaggggcggacgctgcgcgtgctcaagatggtcgagccctggctgcggggcaaccagttctgcatcaagatcctgaacccctacatgccgtccgtggtggagaccctcgagcagatgcagcgcaagcacggcgggatgctggtccggaaccccctgagccgcaactccacccacgagatgtactgggtgagctgcggcaccgggaacatcgtgtccgccgtcaacatgacgagccggatgctcctgaaccgcttcaccatggcccaccgcaagcccaccttcgagcgggacgtggacctgggcgcgggcacccgccacgtggccgtcgagcccgaggtggccaacctcgacatcatcgggcagcggatcgagaacatcaagaacgagcacaagtccacgtggcactacgacgaggacaacccgtacaagacctgggcctaccacggcagctacgaggtgaagccctccgggagcgcctccagcatggtcaacggcgtggtgcgcctgctgaccaagccctgggacgtcatccccatggtgacccagatcgcgatgacggacaccaccccgttcgggcagcagcgggtcttcaaggagaaggtggacacccgcacgccccgggccaagcgcggcaccacccagatcatggaggtgaccgccaagtggctctggggcttcctgtcccggaacaagaagccccgcatctgcacgcgggaggagttcacccgcaaggtccggagcaacgccgccatcggggcggtgttcgtggacgagaaccagtggaacagcgccaaggaggccgtcgaggacgagcgcttctgggacctggtgcaccgggagcgcgagctccacaagcagggcaagtgcgcgacctgcgtgtacaacatgatggggaagcgggagaagaagctgggcgagttcgggaaggcgaagggctcccgcgccatctggtacatgtggctgggcgcccggttcctcgagttcgaggccctggggttcatgaacgaggaccactggttcagccgcgagaactccctgagcggcgtcgagggggagggcctccacaagctggggtacatcctgcgggacatctccaagatcccgggcggcaacatgtacgccgacgacaccgcggggtgggacacgcgcatcaccgaggacgacctccagaacgaggccaagatcaccgacatcatggagcccgagcacgccctgctggccaccagcatcttcaagctcacgtaccagaacaaggtggtgcgcgtccagcggcccgccaagaacggcaccgtgatggacgtgatctcccgccgggaccagcgcgggagcggccaggtcggcacctacgggctgaacaccttcacgaacatggaggtgcagctgatccggcagatggagtccgagggcatcttcctccccagcgagctggagaccccgaacctggcggagcgcgtgctcgactggctggagaagcacggggccgagcggctgaagcgcatggccatctccggcgacgactgcgtcgtgaagcccatcgacgaccggttcgccaccgccctcaccgcgctgaacgacatggggaaggtgcgcaaggacatcccccagtgggagcccagcaagggctggaacgactggcagcaggtcccgttctgctcccaccacttccaccagctgatcatgaaggacggccgggagatcgtggtgccctgccgcaaccaggacgagctcgtcgggcgggcccgcgtgagccagggcgccgggtggtccctgcgggagaccgcctgcctgggcaagagctacgcccagatgtggcagctcatgtacttccaccgccgggacctgcgcctggcggccaacgccatctgctccgccgtgcccgtcgactgggtgcccacgagccggaccacctggagcatccacgcgcaccaccagtggatgaccacggaggacatgctctccgtgtggaaccgcgtctggatcgaggagaacccgtggatggaggacaagacccacgtgagctcctgggaggaggtgccctacctggggaagcgcgaggaccagtggtgcggcagcctgatcggcctcaccgcccgggccacctgggccacgaacatccaggtcgccatcaaccaggtgcgccggctgatcgggaacgagaactacctggactacatgacctccatgaagcgcttcaagaacgagagcgaccccgagggcgcgctctggtga

SEQ ID NO: 8072 - RNA, 9879 nt, synthetic construct
  misc_feature 1..9879: note = derived and/or modified CDS sequence (opt1) from DENV-1__GQ868506__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacgcggaccgagacctggatgagctccgagggcgcctggaagcagatccagcgggtcgagacctgggccctgcggcaccccgggttcacggtgatcgccttcttcctggcgcacgccatcggcaccagcatcacccagaaggggatcatcttcatcctcctgatgctggtgaccccctccatggccatgcgctgcgtcggcatcggcaaccgggacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcgatcctgcgcaagctctgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcgggctgttcggcaaggggagcctcctgacgtgcgccaagttcaagtgcgtgaccaagctggagggcaagatcgtgcagtacgagaacctcaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctgaccctcgactgcagcccccggaccggcctggacttcaacgagatggtgctgctcacgatgaaggagaagtcctggctggtccacaagcagtggttcctggacctcccgctgccctggacctccggggccagcaccagccaggagacctggaaccgccaggacctgctcgtgacgttcaagaccgcccacgcgaagaagcaggaggtggtcgtgctgggctcccaggagggcgccatgcacaccgccctgaccggggccacggagatccagaccagcggcaccaccacgatcttcgccgggcacctcaagtgccggctgaagatggacaagctgaccctcaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctgatcaccgccaacccgatcgtgaccgacaaggagaagcccgtcaacatcgagaccgagccgcccttcggggagagctacatcgtggtgggcgccggcgagaaggcgctcaagctgtcctggttcaagaaggggagctccatcggcaagatgttcgaggccacggcccgcggggcgcgccggatggccatcctgggcgacaccgcgtgggacttcgggagcatcggcggcgtcttcacctccgtggggaagctcgtgcaccaggtcttcggcaccgcctacggggtgctgttcagcggcgtgtcctggacgatgaagatcgggatcggcatcctgctcacctggctgggcctgaacagccgctccaccagcctctccatgacctgcatcgccgtcgggatggtgacgctgtacctgggcgtgatggtccaggccgacagcgggtgcgtgatcaactggaagggccgcgagctcaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcacggtggtcgtgggggacgccaacggcatcctcgcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctgcgcgactcctacacccagatgtgcgaccaccggctcatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctgtggtccaacggcgtgctcgagagcgagatgatcatccccaagatctacgggggcccgatctcccagcacaactaccggcccgggtacttcacccagacggccggcccctggcacctggggaagctggagctcgacttcgacctgtgcgagggcaccaccgtcgtggtggacgagcactgcggcaaccgcgggccgagcctgcggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctggtgcgcagcatggtctccgccggcagcggcgaggtggacagcttctccctcgggatcctgtgcgtgagcatcatgatcgaggaggtcatgcggtcccgctggagccggaagatgctgatgacgggcaccctcgccgtgttcctgctgctcgtgatggggcagctgacctggaacgacctgatccgcctctgcatcatggtcggcgccaacgcgtccgaccgcatggggatgggcaccacgtacctggccctgatggccaccttcaagatgcggccgatgttcgccgtgggcctcctgttccgccggctgaccagccgcgaggtgctcctgctgaccatcgggctctccctggtcgccagcgtggagctgcccaactccctcgaggagctgggcgacgggctggcgatgggcatcatgatgctcaagctgctgacggagttccagccccaccagctctggaccaccctgctgagcctcaccttcatcaagacgaccctgtccctggactacgcctggaagaccaccgccatggccctcagcatcgtctccctgttccccctgtgcctcagcacgacctcccagaagaccacctggctgccggtgctgctcggcagcttcgggtgcaagcccctgaccatgttcctgatcacggagaacaagatctggggccggaagtcctggcccctcaacgaggggatcatggcgatcggcatcgtgagcatcctgctgtccagcctcctgaagaacgacgtccccctggccgggccgctcatcgccggcggcatgctgatcgcctgctacgtgatcagcgggtccagcgccgacctgtccctcgagaaggcggccgaggtgagctgggagcaggaggccgagcactccggcaccagccacaacatcctggtcgaggtgcaggacgacgggaccatgaagatcaaggacgaggagcgcgacgacaccctgacgatcctcctgaaggccaccctgctcgccgtgtccggcgtctaccccatgagcatccccgcgaccctgttcgtgtggtacttctggcagaagaagaagcagcggtccggggtgctgtgggacacccccagcccgcccgaggtcgagcgcgccgtgctcgacgacggcatctaccggatcctgcagcgcggcctgctggggcggtcccaggtgggcgtcggggtgttccaggacggcgtgttccacacgatgtggcacgtcacccgcggggccgtgctcatgtaccagggcaagcggctggagcccagctgggcctccgtgaagaaggacctgatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggcgatcgccctcgacttcaagcccggcaccagcgggtccccgatcgtgaaccgggagggcaagatcgtcggcctgtacgggaacggcgtggtgacgaccagcgggacctacgtctccgccatcgcccaggccaaggcgagccaggagggccccctgcccgagatcgaggacgaggtgttcaagaagcgcaacctcaccatcatggacctgcacccggggagcggcaagacgcggcgctacctgcccgccatcgtgcgggaggccatcaagcgcaagctccggaccctgatcctggcccccacccgcgtcgtggcgtccgagatggccgaggccctcaagggcatgcccatccgctaccagaccacggccgtcaagagcgagcacaccgggcgggagatcgtcgacctgatgtgccacgccaccttcaccatgcgcctgctctccccgggccgggtgcccaactacaacatgatcatcatggacgaggcgcacttcacggaccccgccagcatcgccgcccgcgggtacatctccacccgggtgggcatgggggaggccgcggccatcttcatgaccgccacgccgcccggcagcgtcgaggccttcccccagtccaacgccgtgatccaggacgaggagcgcgacatccccgagcggagctggaactccggctacgactggatcacggacttccccgggaagaccgtgtggttcgtccccagcatcaagtccggcaacgacatcgcgaactgcctgcgcaagaacgggaagcgggtgatccagctgagccgcaagaccttcgacaccgagtaccagaagacgaagaacaacgactgggactacgtggtcaccaccgacatctccgagatgggcgccaacttccgggccgaccgcgtgatcgacccccggcgctgcctcaagcccgtgatcctgaaggacgggcccgagcgggtcatcctggccggcccgatgcccgtgaccgtggcgagcgccgcccagcgccggggccgcatcgggcggaaccagaacaaggagggcgaccagtacgtctacatggggcagcccctcaacaacgacgaggaccacgcccactggacggaggccaagatgctgctggacaacatcaacacccccgagggcatcatcccggccctcttcgagcccgagcgcgagaagtccgccgccatcgacggggagtaccgcctgcggggcgaggcccgcaagaccttcgtggagctgatgcggcgcggcgacctccccgtctggctgagctacaaggtggcctccgaggggttccagtacagcgaccggcgctggtgcttcgacggcgagcggaacaaccaggtgctggaggagaacatggacgtcgagatctggaccaaggagggggagcgcaagaagctccggccccgctggctggacgcgcggacctactccgacccgctggccctccgcgagttcaaggagttcgccgccggccggcgcagcgtgagcggcgacctgatcctggagatcgggaagctcccccagcacctgacgctgcgggcccagaacgcgctcgacaacctggtgatgctgcacaactccgagcagggcgggaaggcctaccgccacgccatggaggagctccccgacaccatcgagaccctgatgctgctcgccctgatcgcggtcctgaccggcggggtgaccctcttcttcctgagcggcaagggcctggggaagacctccatcggcctcctgtgcgtgaccgccagctccgccctgctctggatggccagcgtcgagccccactggatcgccgcgtccatcatcctggagttcttcctgatggtgctcctgatcccggagcccgaccggcagcgcacgccccaggacaaccagctggcctacgtggtcatcgggctcctgttcatgatcctgacggtggccgccaacgagatgggcctcctggagaccaccaagaaggacctggggatcggccacgtggccgcggagaaccaccagcacgccaccatgctcgacgtcgacctgcggccggccagcgcctggacgctgtacgccgtggcgaccaccgtgatcacccccatgatgcgccacacgatcgagaacaccaccgccaacatctccctcaccgccatcgccaaccaggccgcgatcctgatgggcctggacaaggggtggcccatcagcaagatggacatcggcgtccccctcctggccctggggtgctactcccaggtgaacccgctcacgctgaccgccgccgtgctgatgctcgtcgcgcactacgccatcatcggccccgggctgcaggccaaggccacccgggaggcccagaagcgcaccgcggccggcatcatgaagaaccccacggtggacggcatcgtggccatcgacctggaccccgtcgtgtacgacgccaagttcgagaagcagctcgggcagatcatgctgctgatcctctgcaccagccagatcctgctgatgcgcaccacctgggccctctgcgagtccatcacgctggcgaccggcccgctgaccaccctctgggaggggagccccggcaagttctggaacacgaccatcgccgtgtccatggccaacatcttccggggcagctacctggccggggccggcctggcgttctccctcatgaagtccctcgggggcgggcgccgggggaccggcgcccagggggagaccctgggcgagaagtggaagcgccagctcaaccagctgtccaagagcgagttcaacacgtacaagcggagcgggatcatggaggtcgaccgctccgaggccaaggagggcctgaagcgcggggagaccaccaagcacgccgtgagccgcggcaccgcgaagctccggtggttcgtggagcgcaacctggtcaagcccgagggcaaggtgatcgacctggggtgcggccgcgggggctggtcctactactgcgccgggctgaagaaggtgaccgaggtcaagggctacacgaagggcgggcccggccacgaggagccgatccccatggccacctacgggtggaacctcgtgaagctgcacagcggcaaggacgtgttcttcatgccgcccgagaagtgcgacaccctgctctgcgacatcggggagtccagcccgaaccccaccatcgaggagggccgcacgctgcgggtcctgaagatggtggagccctggctccgcggcaaccagttctgcatcaagatcctgaacccctacatgccgtccgtggtcgaggccctggagcagatgcagcggaagcacgggggcatgctcgtgcgcaaccccctgagccggaactccacccacgagatgtactgggtgagctgcgggaccggcaacatcgtctccgccgtgaacatgaccagccgcatgctgctcaaccggttcacgatggcgcaccgcaagcccacctacgagcgcgacgtggacctgggcgccgggacccggcacgtcgccgtggagcccgaggtggccaacctggacatcatcggccagcgcatcgagaacatcaagaacgagcacaagtccacctggcactacgacgaggacaacccgtacaagacgtgggcctaccacgggagctacgaggtcaagccctccggcagcgcgtccagcatggtgaacggggtggtccggctcctgaccaagccctgggacgtgatccccatggtcacccagatcgccatgaccgacacgaccccgttcggccagcagcgcgtgttcaaggagaaggtggacacccggacgccccgggccaagcggggcacgacccagatcatggaggtcaccgccaagtggctgtgggggttcctctcccgcaacaagaagccccggatctgcacccgcgaggagttcacgcggaaggtgcgcagcaacgccgcgatcggcgccgtgttcgtcgacgagaaccagtggaacagcgccaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaagggctcccgggccatctggtacatgtggctgggggcccgcttcctggagttcgaggccctcggcttcatgaacgaggaccactggttcagccgggagaactccctgagcggggtggagggcgaggggctgcacaagctcggctacatcctgcgcgacatctccaagatcccgggcgggaacatgtacgcggacgacaccgccggctgggacacccggatcacggaggacgacctgcagaacgaggccaagatcaccgagatcatggagcccgagcacgccctcctggccaccagcatcttcaagctgacctaccagaacaaggtggtccgcgtgcagcgccccgcgaagaacgggacggtgatggacgtcatctcccggcgcgaccagcggggcagcggccaggtggggacctacggcctcaacaccttcaccaacatggaggtgcagctgatccgccagatggagtccgaggggatcttcctgcccagcgagctcgagacgccgaacctggccgagcgggtcctggactggctcgagaagcacggcgccgagcgcctgaagcggatggccatctccggggacgactgcgtggtgaagcccatcgacgaccgcttcgccaccgcgctgaccgccctcaacgacatgggcaaggtccggaaggacatcccccagtgggagcccagcaagggctggaacgactggcagcaggtcccgttctgctcccaccacttccaccagctgatcatgaaggacgggcgcgagatcgtggtcccctgccggaaccaggacgagctggtgggccgcgcccgggtgagccagggggccggctggtccctccgcgagaccgcctgcctgggcaagagctacgcgcagatgtggcagctgatgtacttccaccggcgcgacctccggctggccgccaacgccatctgctccgcggtccccgtggactgggtgcccaccagccgcacgacctggagcatccacgcccaccaccagtggatgaccaccgaggacatgctgtccgtctggaaccgggtgtggatcgaggagaacccgtggatggaggacaagacgcacgtgagctcctgggaggaggtcccctacctcggcaagcgcgaggaccagtggtgcggcagcctgatcgggctgaccgcccgcgccacctgggccaccaacatccaggtggcgatcaaccaggtgcggcgcctcatcggcaacgagaactacctggactacatgacgtccatgaagcggttcaagaacgagagcgaccccgagggggccctgtggtga

SEQ ID NO: 8073 - RNA, 9879 nt, synthetic construct
  misc_feature 1..9879: note = derived and/or modified CDS sequence (opt1) from DENV-1__GQ868507__SS-prME
  source 1..9879: mol_type = other RNA
agcgtgaccatgctgctcatgctgctgcccaccgccctcgccttccacctgaccacccggggcggggagccgcacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctggtgatggggcagctgacctggaacgacctcatccgcctgtgcatcatggtgggcgcgaacgcctccgaccgcatggggatgggcaccacgtacctggccctcatggccaccttcaagatgcggccgatgttcgccgtcgggctgctgttccgccggctcaccagccgcgaggtgctgctgctcaccatcgggctgtccctggtggcgagcgtcgagctccccaactccctggaggagctgggcgacgggctcgccatgggcatcatgatgctgaagctgctcacggagttccagccccaccagctgtggatcaccctgctcagcctgaccttcatcaagaccacgctgtccctcgactacgcctggaagaccaccgccatggcgctgagcatcgtgtccctgttccccctctgcctgagcaccacgtcccagaagaccacctggctgccggtcctcctgggcagcttcgggtgcaagcccctgaccatgttcctcatcaccgagaacaagatctggggccggaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggtccagcgcggacctctccctggagaaggccgccgaggtgagctgggagcaggaggccgagcactccggcacgagccacaacatcctggtggaggtccaggacgacgggaccatgaagatcaaggacgaggagcgcgacgacaccctcaccatcctgctgaaggccacgctcctggcggtgtccggcgtgtaccccatgagcatccccgccaccctgttcgtctggtacttctggcagaagaagaagcagcggtccggggtgctctgggacacccccagcccgcccgaggtggagcgcgccgtcctggacgacggcatctaccggatcctgcagcgcggcctgctcgggcggtcccaggtgggcgtgggggtcttccaggacggcgtgttccacaccatgtggcacgtgacgcgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgcggtggagcccgggaagaacccgaagaacgtgcagaccatgcccggcaccttcaagacgcccgagggcgaggtcggggccatcgccctggacttcaagcccggcaccagcgggtccccgatcgtgaaccgggagggcaagatcgtgggcctgtacgggaacggcgtcgtgaccaccagcgggacgtacgtgtccgccatcgcccaggcgaaggccagccaggagggccccctccccgagatcgaggacgaggtcttcaagaagcgcaacctgaccatcatggacctgcacccggggagcggcaagacccggcgctacctccccgccatggtgcgggaggccatcaagcgcaagctgcggaccctgatcctcgcgcccacgcgcgtggtcgcctccgagatggccgaggccctgaagggcatgcccatccgctaccagaccaccgccgtcaagagcgagcacaccgggcgggagatcgtggacctgatgtgccacgcgacgttcaccatgcgcctcctgtccccggtccgggtgcccaactacaacatgatcatcatggacgaggcccacttcaccgaccccgccagcatcgccgcccgcggctacatctccacccgggtggggatgggcgaggcggccgccatcttcatgacggccacgccgcccgggagcgtcgaggccttcccccagtccaacgcggtgatccaggacgaggagcgcgacatccccgagcggagctggaactccggctacgactggatcaccgacttccccggcaagaccgtgtggttcgtccccagcatcaagtccgggaacgacatcgccaactgcctgcgcaagaacggcaagcgggtgatccagctcagccgcaagacgttcgacaccgagtaccagaagaccaagaacaacgactgggactacgtggtcaccacggacatctccgagatgggggccaacttccgggccgaccgcgtgatcgacccccggcgctgcctgaagcccgtgatcctgaaggacggccccgagcgggtcatcctcgcggggccgatgcccgtgaccgtggccagcgccgcccagcgccggggccgcatcggccggaaccagaacaaggagggggaccagtacgtctacatgggccagcccctgaacaacgacgaggaccacgcccactggaccgaggcgaagatgctgctcgacaacatcaacacccccgaggggatcatcccggccctgttcgagcccgagcgcgagaagtccgccgccatcgacggcgagtaccgcctgcgcggggaggcccgcaagacgttcgtggagctcatgcggcgcggcgacctgcccgtctggctgagctacaaggtggcgtccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgaccctccgggcgcagaacgccctggacaacctggtgatgctccacaactccgagcagggcgggaaggcctaccgccacgccatggaggagctgcccgacaccatcgagacgctgatgctcctggcgctgatcgccgtcctcaccgggggcgtgaccctgttcttcctgagcgggaagggcctcggcaagacctccatcgggctgctgtgcgtgacggccagctccgccctcctgtggatggccagcgtcgagccccactggatcgcggcctccatcatcctggagttcttcctcatggtgctgctgatcccggagcccgaccggcagcgcacgccccaggacaaccagctcgcctacgtggtcatcggcctgctgttcatgatcctcaccgtggccgccaacgagatggggctgctggagaccacgaagaaggacctcggcatcgggcacgtggcggccgagaaccaccagcacgccaccatgctggacgtcgacctgcggccggccagcgcctggaccctctacgcggtggccaccacggtgatcacccccatgatgcgccacaccatcgagaacaccacggccaacatctccctgaccgccatcgccaaccaggcggccatcctgatgggcctcgacaagggctggcccatcagcaagatggacatcggggtccccctgctggccctcggctgctactcccaggtgaacccgctgaccctgaccgccgcggtgctcatgctggtcgcccactacgccatcatcgggcccggcctgcaggccaaggccacgcgggaggcgcagaagcgcaccgccgccgggatcatgaagaaccccaccgtggacggcatcgtggccatcgacctcgaccccgtcgtgtacgacgccaagttcgagaagcagctgggccagatcatgctgctcatcctgtgcaccagccagatcctgctcatgcgcacgacctgggcgctgtgcgagtccatcaccctggccaccgggccgctcacgaccctgtgggagggcagccccgggaagttctggaacaccaccatcgccgtgtccatggccaacatcttccggggcagctacctggccggcgcggggctcgccttctccctgatgaagtccctgggcgggggccgccgggggacgggcgcccagggcgagaccctcggggagaagtggaagcgccagctgaaccagctgtccaagagcgagttcaacacctacaagcggagcggcatcatggaggtcgaccgctccgaggccaaggaggggctcaagcggggcgagaccacgaagcacgcggtgagccgcgggaccgccaagctgcggtggttcgtggagcgcaacctggtcaagcccgagggcaaggtgatcgacctgggctgcgggcggggcgggtggtcctactactgcgccggcctcaagaaggtgaccgaggtcaaggggtacaccaagggcggccccgggcacgaggagccgatccccatggccacctacggctggaacctggtgaagctgcccagcgggaaggacgtgttcttcatgcccccggagaagtgcgacacgctcctgtgcgacatcggcgagtccagccccaaccccaccatcgaggaggggcgcaccctgcgggtcctcaagatggtggagccctggctgcgcggcaaccagttctgcatcaagatcctgaacccgtacatgccctccgtggtcgagaccctcgagcagatgcagcggaagcacggcgggatgctggtgcgcaaccccctgagccggaactccacgcacgagatgtactgggtgagctgcggcaccgggaacatcgtctccgccgtgaacatgaccagccgcatgctcctgaaccggttcaccatggcgcaccgcaagcccacgtacgagcgcgacgtggacctgggcgccggcacccggcacgtcgccgtggagccggaggtggccaacctcgacatcatcgggcagcgcatcgagaacatcaagaacgagcacaagtccacctggcactacgacgaggacaacccctacaagacctgggcctaccacggcagctacgaggtcaagccctccgggagcgcgtccagcatggtgaacggcgtggtccggctgctgacgaagccctgggacgtgatcccgatggtcacccagatcgccatgaccgacaccacgcccttcgggcagcagcgcgtgttcaaggagaaggtggacacccggacgccccgggccaagcggggcaccacgcagatcatggaggtcaccgccaagtggctctggggcttcctgtcccgcaacaagaagccgcggatctgcacccgcgaggagttcacccggaaggtgcgcagcaacgccgcgatcggggccgtgttcgtcgacgagaaccagtggaacagcgccaaggaggccgtggaggacgagcggttctgggacctggtgcaccgcgagcgggagctccacaagcagggcaagtgcgcgacgtgcgtctacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatccccggcggcaacatgtacgcggacgacaccgccgggtgggacacccggatcaccgaggacgacctccagaacgaggccaagatcacggagatcatggagcccgagcacgccctgctggccaccagcatcttcaagctcacctaccagaacaaggtggtccgcgtgcagcgccccgcgaagaacggcaccgtgatggacgtcatctcccggcgcgaccagcgggggagcggccaggtgggcacgtacgggctgaacaccttcaccaacatggaggtgcagctgatccgccagatggagtccgagggcatcttcctcccgagcgagctggagacccccaacctggccgagcgggtcctcgactggctggagaagcacggggccgagcgcctgaagcggatggccatctccggcgacgactgcgtggtgaagcccatcgacgaccgcttcgccacggcgctcaccgccctgaacgacatggggaaggtccggaaggacatcccccagtgggagccgagcaagggctggaacgactggcagcaggtccccttctgctcccaccacttccaccagctgatcatgaaggacggccgcgagatcgtggtcccctgccggaaccaggacgagctcgtggggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgctccgcggtccccgtggactgggtgccgaccagccgcaccacgtggagcatccacgcccaccaccagtggatgaccaccgaggacatgctctccgtctggaaccgggtgtggatcgaggagaacccctggatggaggacaagacccacgtgagctcctgggaggaggtcccctacctggggaagcgcgaggaccagtggtgcggcagcctgatcggcctcacggcccgcgccacctgggccaccaacatccaggtggcgatcaaccaggtgcggcgcctgatcgggaacgagaactacctggactacatgacctccatgaagcggttcaagaacgagagcgaccccgagggcgccctctggtga

SEQ ID NO: 8074 - RNA, 9879 nt, synthetic construct
  misc_feature 1..9879: note = derived and/or modified CDS sequence (opt1) from DENV-1__GQ868508__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctggtgatggggcagctgacctggaacgacctcatccgcctgtgcatcatggtgggcgcgaacgcctccgaccgcatggggatgggcaccacgtacctggccctcatggccaccttcaagatgcggccgatgttcgccgtcgggctgctgttccgccggctcaccagccgcgaggtgctgctgctcaccatcgggctgtccctggtggcgagcgtcgagctccccaactccctggaggagctgggcgacgggctcgccatgggcatcatgatgctgaagctgctcacggagttccagccccaccagctgtggatcaccctgctcagcctgaccttcatcaagaccacgctgtccctcgactacgcctggaagaccaccgccatggcgctgagcatcgtgtccctgttccccctctgcctgagcaccacgtcccagaagaccacctggctgccggtcctcctgggcagcttcgggtgcaagcccctgaccatgttcctcatcaccgagaacaagatctggggccggaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggtccagcgcggacctctccctggagaaggccgccgaggtgagctgggagcaggaggccgagcactccggcacgagccacaacatcctggtggaggtccaggacgacgggaccatgaagatcaaggacgaggagcgcgacgacaccctcaccatcctgctgaaggccacgctcctggcggtgtccggcgtgtaccccatgagcatccccgccaccctgttcgtctggtacttctggcagaagaagaagcagcggtccggggtgctctgggacacccccagcccgcccgaggtggagcgcgccgtcctggacgacggcatctaccggatcctgcagcgcggcctgctcgggcggtcccaggtgggcgtgggggtcttccaggacggcgtgttccacaccatgtggcacgtgacgcgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgcggtggagcccgggaagaacccgaagaacgtgcagaccatgcccggcaccttcaagacgcccgagggcgaggtcggggccatcgccctggacttcaagcccggcaccagcgggtccccgatcgtgaaccgggagggcaagatcgtgggcctgtacgggaacggcgtcgtgaccaccagcgggacgtacgtgtccgccatcgcccaggcgaaggccagccaggagggccccctccccgagatcgaggacgaggtcttcaagaagcgcaacctgaccatcatggacctgcacccggggagcggcaagacccggcgctacctccccgccatggtgcgggaggccatcaagcgcaagctgcggaccctgatcctcgcgcccacgcgcgtggtcgcctccgagatggccgaggccctgaagggcatgcccatccgctaccagaccaccgccgtcaagagcgagcacaccgggcgggagatcgtggacctgatgtgccacgcgacgttcaccatgcgcctcctgtccccggtccgggtgcccaactacaacatgatcatcatggacgaggcccacttcaccgaccccgccagcatcgccgcccgcggctacatctccacccgggtggggatgggcgaggcggccgccatcttcatgacggccacgccgcccgggagcgtcgaggccttcccccagtccaacgcggtgatccaggacgaggagcgcgacatccccgagcggagctggaactccggctacgactggatcaccgacttccccggcaagaccgtgtggttcgtccccagcatcaagtccgggaacgacatcgccaactgcctgcgcaagaacggcaagcgggtgatccagctcagccgcaagacgttcgacaccgagtaccagaagaccaagaacaacgactgggactacgtggtcaccacggacatctccgagatgggggccaacttccgggccgaccgcgtgatcgacccccggcgctgcctgaagcccgtgatcctgaaggacggccccgagcgggtcatcctcgcggggccgatgcccgtgaccgtggccagcgccgcccagcgccggggccgcatcggccggaaccagaacaaggagggggaccagtacgtctacatgggccagcccctgaacaacgacgaggaccacgcccactggaccgaggcgaagatgctgctcgacaacatcaacacccccgaggggatcatcccggccctgttcgagcccgagcgcgagaagtccgccgccatcgacggcgagtaccgcctgcgcggggaggcccgcaagacgttcgtggagctcatgcggcgcggcgacctgcccgtctggctgagctacaaggtggcgtccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgaccctccgggcgcagaacgccctggacaacctggtgatgctccacaactccgagcagggcgggaaggcctaccgccacgccatggaggagctgcccgacaccatcgagacgctgatgctcctggcgctgatcgccgtcctcaccgggggcgtgaccctgttcttcctgagcgggaagggcctcggcaagacctccatcgggctgctgtgcgtgacggccagctccgccctcctgtggatggccagcgtcgagccccactggatcgcggcctccatcatcctggagttcttcctcatggtgctgctgatcccggagcccgaccggcagcgcacgccccaggacaaccagctcgcctacgtggtcatcggcctgctgttcatgatcctcaccgtggccgccaacgagatggggctgctggagaccacgaagaaggacctcggcatcgggcacgtggcggccgagaaccaccagcacgccaccatgctggacgtcgacctgcggccggccagcgcctggaccctctacgcggtggccaccacggtgatcacccccatgatgcgccacaccatcgagaacaccacggccaacatctccctgaccgccatcgccaaccaggcggccatcctgatgggcctcgacaagggctggcccatcagcaagatggacatcggggtccccctgctggccctcggctgctactcccaggtgaacccgctgaccctgaccgccgcggtgctcatgctggtcgcccactacgccatcatcgggcccggcctgcaggccaaggccacgcgggaggcgcagaagcgcaccgccgccgggatcatgaagaaccccaccgtggacggcatcgtggccatcgacctcgaccccgtcgtgtacgacgccaagttcgagaagcagctgggccagatcatgctgctcatcctgtgcaccagccagatcctgctcatgcgcacgacctgggcgctgtgcgagtccatcaccctggccaccgggccgctcacgaccctgtgggagggcagccccgggaagttctggaacaccaccatcgccgtgtccatggccaacatcttccggggcagctacctggccggcgcggggctcgccttctccctgatgaagtccctgggcgggggccgccgggggacgggcgcccagggcgagaccctcggggagaagtggaagcgccagctgaaccagctgtccaagagcgagttcaacacctacaagcggagcggcatcatggaggtcgaccgctccgaggccaaggaggggctcaagcggggcgagaccacgaagcacgcggtgagccgcgggaccgccaagctgcggtggttcgtggagcgcaacctggtcaagcccgagggcaaggtgatcgacctgggctgcgggcggggcgggtggtcctactactgcgccggcctcaagaaggtgaccgaggtcaaggggtacaccaagggcggccccgggcacgaggagccgatccccatggccacctacggctggaacctggtgaagctgcacagcgggaaggacgtgttcttcatgccgcccgagaagtgcgacacgctcctgtgcgacatcggcgagtccagcccgaaccccaccatcgaggaggggcgcaccctgcgggtcctcaagatggtggagccctggctgcgcggcaaccagttctgcatcaagatcctgaacccctacatgccgtccgtggtcgagaccctcgagcagatgcagcggaagcacggcgggatgctggtgcgcaaccccctgagccggaactccacgcacgagatgtactgggtgagctgcggcaccgggaacatcgtctccgccgtgaacatgaccagccgcatgctcctgaaccggttcaccatggcgcaccgcaagcccacgtacgagcgcgacgtggacctgggcgccggcacccggcacgtcgccgtggagcccgaggtggccaacctcgacatcatcgggcagcgcatcgagaacatcaagaacgagcacaagtccacctggcactacgacgaggacaacccgtacaagacctgggcctaccacggcagctacgaggtcaagccctccgggagcgcgtccagcatggtgaacggcgtggtccggctgctgacgaagccctgggacgtgatccccatggtcacccagatcgccatgaccgacaccacgccgttcgggcagcagcgcgtgttcaaggagaaggtggacacccggacgccccgggccaagcggggcaccacgcagatcatggaggtcaccgccaagtggctctggggcttcctgtcccgcaacaagaagccccggatctgcacccgcgaggagttcacccggaaggtgcgcagcaacgccgcgatcggggccgtgttcgtcgacgagaaccagtggaacagcgccaaggaggccgtggaggacgagcggttctgggacctggtgcaccgcgagcgggagctccacaagcagggcaagtgcgcgacgtgcgtctacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacaccgccgggtgggacacccggatcaccgaggacgacctccagaacgaggccaagatcacggagatcatggagcccgagcacgccctgctggccaccagcatcttcaagctcacctaccagaacaaggtggtccgcgtgcagcgccccgcgaagaacggcaccgtgatggacgtcatctcccggcgcgaccagcgggggagcggccaggtgggcacgtacgggctgaacaccttcaccaacatggaggtgcagctgatccgccagatggagtccgagggcatcttcctccccagcgagctggagaccccgaacctggccgagcgggtcctcgactggctggagaagcacggggccgagcgcctgaagcggatggccatctccggcgacgactgcgtggtgaagcccatcgacgaccgcttcgccacggcgctcaccgccctgaacgacatggggaaggtccggaaggacatcccccagtgggagcccagcaagggctggaacgactggcagcaggtcccgttctgctcccaccacttccaccagctgatcatgaaggacggccgcgagatcgtggtcccctgccggaaccaggacgagctcgtggggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgctccgcggtccccgtggactgggtgcccaccagccgcaccacgtggagcatccacgcccaccaccagtggatgaccaccgaggacatgctctccgtctggaaccgggtgtggatcgaggagaacccgtggatggaggacaagacccacgtgagctcctgggaggaggtcccctacctggggaagcgcgaggaccagtggtgcggcagcctgatcggcctcacggcccgcgccacctgggccaccaacatccaggtggcgatcaaccaggtgcggcgcctgatcgggaacgagaactacctggactacatgacctccatgaagcggttcaagaacgagagcgaccccgagggcgccctctggtga

SEQ ID NO: 8075 - RNA, 9879 nt, synthetic construct
  misc_feature 1..9879: note = derived and/or modified CDS sequence (opt1) from DENV-1__GQ868509__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctgttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagatgagcggcaccaccaccatcttcgccgggcacctgaagtgccggctgaagatggacaagctcacgctgaagggcacctcctacgtgatgtgcaccgggagcttcaagctggagaaggaggtcgcggagacccagcacggcacggtgctggtgcaggtcaagtacgagggcaccgacgccccctgcaagatccccttctccacccaggacgagaagggggtgacccagaacggccgcctcatcacggccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtcttcacctccgtggggaagctggtgcaccaggtcttcggcaccgcctacggggtgctgttcagcggcgtgtcctggaccatgaagatcgggatcggcatcctcctgacgtggctgggcctcaacagccgctccaccagcctgtccatgacctgcatcgccgtcgggatggtgaccctgtacctcggcgtgatggtccaggccgacagcgggtgcgtgatcaactggaagggccgcgagctgaagtgcgggtccggcatcttcgtgacgaacgaggtccacacctggaccgagcagtacaagttccaggccgacagcccgaagcggctgagcgcggccatcggcaaggcctgggaggagggggtgtgcggcatccgctccgtgacccggctcgagaacatcatgtggaagcagatcagcaacgagctgaaccacatcctgctcgagaacgacatgaagttcaccgtcgtggtgggggacgccaacggcatcctggcccaggggaagaagatgatccgcccccagcccatggagcacaagtactcctggaagtcctggggcaaggcgaagatcatcggcgccgacatccagaacacgaccttcatcatcgacgggcccgacaccccggagtgccccgacaaccagcgggcctggaacatctgggaggtcgaggactacggcttcgggatcttcaccacgaacatctggctgaagctccgcgactcctacacccagatgtgcgaccaccggctgatgagcgccgcgatcaaggactccaaggccgtgcacgccgacatgggctactggatcgagagcgagaagaacgagacctggaagctggcccgcgcctccttcatcgaggtgaagacctgcacgtggcccaagagccacaccctctggtccaacggcgtcctggagagcgagatgatcatccccaagatctacgggggcccgatctcccagcacaactaccggcccgggtacttcacccagaccgcgggcccctggcacctggggaagctcgagctggacttcgacctgtgcgagggcacgaccgtggtggtcgacgagcactgcggcaaccgcgggccgagcctccggaccaccacggtgaccggcaagatcatccacgagtggtgctgccgctcctgcaccctgccgcccctgcggttccgcggggaggacggctgctggtacgggatggagatccggcccgtgaaggagaaggaggagaacctcgtccgcagcatggtgtccgccggcagcggcgaggtggacagcttctccctggggatcctgtgcgccagcatcatgatcgaggaggtcatgcggtcccgctggagccggaagatgctcatgaccggcacgctggccgtgttcctgctcctgatcatggggcagctgacctggaacgacctcatccgcctgtgcatcatggtgggcgccaacgcgtccgaccgcatggggatgggcaccacctacctggccctcatggccacgttcaagatgcggccgatgttcgccgtcgggctgctgttccgccggctcaccagccgcgaggtgctgctgctcaccatcgggctgtccctggtggccagcgtcgagctccccaactccctggaggagctgggcgacgggctcgcgatgggcatcatgatgctgaagctgctcaccgagttccagccccaccagctgtggacgaccctgctcagcctgaccttcatcaagaccacgctgtccctcgactacgcctggaagaccaccgccatggccctgagcatcgtgtccctgttccccctctgcctgagcaccacgtcccagaagaccacctggctgccggtcctcctgggcagcttcgggtgcaagcccctgaccatgttcctcatcaccgagaacaagatctggggccggaagtcctggcccctgaacgaggggatcatggcgatcggcatcgtgagcatcctgctctccagcctgctgaagaacgacgtgcccctcgccgggccgctgatcgccggcggcatgctgatcgcctgctacgtcatcagcgggtccagcgccgacctctccctggagaaggcggccgaggtgagctgggagcaggaggccgagcactccggcacgagccacaacatcctggtggaggtccaggacgacgggaccatgaagatcaaggacgaggagcgcgacgacaccctcaccatcctgctgaaggccacgctcctggccgtgtccggcgtgtaccccatgagcatccccgcgaccctgttcctctggtacttctggcagaagaagaagcagcggtccggggtcctgtgggacacccccagcccgcccgaggtggagcgcgccgtgctggacgacggcatctaccggatcctgcagcgcggcctcctggggcggtcccaggtcggcgtgggggtgttccaggacggcgtcttccacaccatgtggcacgtgacgcgcggggccgtgctgatgtaccagggcaagcggctcgagcccagctgggcctccgtcaagaaggacctgatcagctacggcgggggctggcgcttccaggggtcctggaacaccggcgaggaggtccaggtgatcgccgtcgagcccgggaagaacccgaagaacgtgcagaccacccccggcacgttcaagacccccgagggcgaggtgggggcgatcgccctggacttcaagcccggcaccagcgggtccccgatcgtcaaccgggagggcaagatcgtgggcctctacgggaacggcgtggtcaccacgagcgggacctacgtgtccgccatcgcccaggccaaggcgagccaggagggccccctgcccgagatcgaggacgaggtgttcaagaagcgcaacctgaccatcatggacctccacccggggagcggcaagacccggcgctacctgcccgccatcgtccgggaggccatcaagcgcaagctgcggacgctcatcctggcccccacccgcgtggtggcgtccgagatggccgaggccctgaagggcatgcccatccgctaccagaccaccgccgtcaagagcgagcacacggggcgggagatcgtggacctcatgtgccacgccaccttcaccatgcgcctgctgtccccggtgcgggtccccaactacaacatgatcatcatggacgaggcgcacttcaccgaccccgccagcatcgccgcccgcggctacatctccacgcgggtggggatgggcgaggccgcggccatcttcatgaccgccacgccgcccgggagcgtggaggccttcccccagtccaacgccgtcatccaggacgaggagcgcgacatccccgagcggagctggaactccggctacgactggatcaccgacttccccggcaagacggtgtggttcgtgcccagcatcaagtccgggaacgacatcgcgaactgcctccgcaagaacggcaagcgggtcatccagctgagccgcaagaccttcgacaccgagtaccagaagaccaagaacaacgactgggactacgtggtgacgaccgacatctccgagatgggggccaacttccgggccgaccgcgtcatcgacccccggcgctgcctgaagcccgtgatcctcaaggacggccccgagcgggtgatcctggccgggccgatgcccgtcaccgtggcgagcgccgcccagcgccggggccgcatcggccggaaccagaacaaggagggggaccagtacgtgtacatgggccagcccctgaacaacgacgaggaccacgcccactggaccgaggccaagatgctcctggacaacatcaacacgcccgaggggatcatcccggcgctgttcgagcccgagcgcgagaagtccgccgccatcgacggcgagtaccgcctccgcggggaggcccgcaagaccttcgtcgagctgatgcggcgcggcgacctgcccgtgtggctcagctacaaggtcgcctccgagggcttccagtacagcgaccggcgctggtgcttcgacggggagcggaacaaccaggtgctggaggagaacatggacgtggagatctggaccaaggagggcgagcgcaagaagctgcggccccgctggctcgacgcgcggacctactccgacccgctggccctgcgcgagttcaaggagttcgccgccgggcggcgcagcgtcagcggcgacctcatcctggagatcggcaagctgccccagcacctcaccctgcgggcccagaacgcgctggacaacctcgtgatgctgcacaactccgagcagggcgggaaggcctaccgccacgccatggaggagctgcccgacacgatcgagaccctcatgctgctggccctcatcgcggtgctgaccgggggcgtcaccctgttcttcctcagcgggaagggcctgggcaagacgtccatcgggctgctctgcgtgaccgccagctccgccctgctgtggatggccagcgtggagccccactggatcgccgcgtccatcatcctcgagttcttcctgatggtcctgctcatcccggagcccgaccggcagcgcacgccccaggacaaccagctggcctacgtggtgatcggcctcctcttcatgatcctgaccgtcgccgccaacgagatggggctgctcgagacgaccaagaaggacctgggcatcgggcacgtggccgcggagaaccaccagcacgccaccatgctggacgtggacctccggccggccagcgcctggaccctgtacgccgtcgcgacgaccgtgatcacccccatgatgcgccacaccatcgagaacacgaccgccaacatctccctgaccgccatcgccaaccaggccgcgatcctcatgggcctggacaagggctggcccatcagcaagatggacatcggggtgcccctgctcgccctgggctgctactcccaggtcaacccgctgaccctcacggccgccgtgctgatgctggtggcgcactacgccatcatcgggcccggcctccaggccaaggccacccgggaggcccagaagcgcaccgcggccgggatcatgaagaaccccaccgtcgacggcatcgtggccatcgacctggaccccgtggtctacgacgccaagttcgagaagcagctgggccagatcatgctcctgatcctgtgcacgagccagatcctcctgatgcgcaccacctgggccctgtgcgagtccatcaccctcgcgacggggccgctgaccaccctgtgggagggcagccccgggaagttctggaacaccacgatcgccgtgtccatggccaacatcttccggggcagctacctcgccggcgccgggctggcgttctccctgatgaagtccctcggcgggggccgccgggggaccggcgcccagggcgagaccctgggggagaagtggaagcgccagctgaaccagctctccaagagcgagttcaacacctacaagcggagcggcatcatggaggtggaccgctccgaggccaaggaggggctgaagcggggcgagacgaccaagcacgccgtcagccgcgggaccgcgaagctgcggtggttcgtggagcgcaacctggtgaagcccgagggcaaggtcatcgacctcggctgcgggcggggcgggtggtcctactactgcgccggcctgaagaaggtgaccgaggtgaaggggtacaccaagggcggccccgggcacgaggagccgatccccatggccacgtacggctggaacctggtcaagctccacagcgggaaggacgtgttcttcatgccgcccgagaagtgcgacaccctgctgtgcgacatcggcgagtccagcccgaaccccaccatcgaggaggggcgcaccctccgggtgctgaagatggtcgagccctggctgcgcggcaaccagttctgcatcaagatcctcaacccctacatgccgtccgtggtggagacgctggagcagatgcagcggaagcacggcgggatgctggtccgcaaccccctcagccggaactccacccacgagatgtactgggtgagctgcggcaccgggaacatcgtgtccgccgtcaacatgaccagccgcatgctgctgaaccggttcacgatggcccaccgcaagcccaccttcgagcgcgacgtggacctcggcgcgggcacccggcacgtggccgtcgagcccgaggtggccaacctggacatcatcgggcagcgcatcgagaacatcaagaacgagcacaagtccacctggcactacgacgaggacaacccgtacaagacgtgggcctaccacggcagctacgaggtgaagccctccgggagcgcctccagcatggtcaacggcgtggtgcggctgctcaccaagccctgggacgtcatccccatggtgacccagatcgcgatgaccgacacgaccccgttcgggcagcagcgcgtcttcaaggagaaggtggacacccggacgccccgggccaagcggggcacgacccagatcatggaggtgaccgccaagtggctgtggggcttcctgtcccgcaacaagaagccccggatctgcacccgcgaggagttcacgcggaaggtccgcagcaacgccgccatcggggcggtgttcgtggacgagaaccagtggaacagcgccaaggaggccgtcgaggacgagcggttctgggacctcgtgcaccgcgagcgggagctgcacaagcagggcaagtgcgcgacctgcgtgtacaacatgatggggaagcgcgagaagaagctgggcgagttcgggaaggcgaagggctcccgggccatctggtacatgtggctcggcgcccgcttcctggagttcgaggccctggggttcatgaacgaggaccactggttcagccgggagaactccctcagcggcgtcgagggggagggcctgcacaagctggggtacatcctccgcgacatctccaagatcccgggcggcaacatgtacgccgacgacaccgcggggtgggacacccggatcacggaggacgacctgcagaacgaggccaagatcaccgacatcatggagcccgagcacgccctgctcgccaccagcatcttcaagctgacctaccagaacaaggtggtgcgcgtccagcgccccgccaagaacggcacggtgatggacgtgatctcccggcgcgaccagcgggggagcggccaggtcggcacctacgggctgaacaccttcaccaacatggaggtgcagctcatccgccagatggagtccgagggcatcttcctgcccagcgagctggagacgccgaacctcgcggagcgggtgctggactggctggagaagcacggggccgagcgcctcaagcggatggccatctccggcgacgactgcgtcgtgaagcccatcgacgaccgcttcgccaccgccctgaccgcgctgaacgacatggggaaggtgcggaaggacatcccccagtgggagcccagcaagggctggaacgactggcagcaggtcccgttctgctcccaccacttccaccagctcatcatgaaggacggccgcgagatcgtggtgccctgccggaaccaggacgagctggtcgggcgcgcccgggtgagccagggcgccgggtggtccctgcgcgagaccgcctgcctcggcaagagctacgcccagatgtggcagctgatgtacttccaccggcgcgacctgcggctcgcggccaacgccatctgctccgccgtgcccgtcgactgggtgcccaccagccgcacgacctggagcatccacgcgcaccaccagtggatgaccaccgaggacatgctgtccgtgtggaaccgggtctggatcgaggagaacccgtggatggaggacaagacgcacgtgagctcctgggaggaggtgccctacctggggaagcgcgaggaccagtggtgcggcagcctcatcggcctgaccgcccgcgccacctgggccaccaacatccaggtcgccatcaaccaggtgcggcgcctgatcgggaacgagaactacctcgactacatgacgtccatgaagcggttcaagaacgagagcgaccccgagggcgcgctgtggtga

SEQ ID NO: 8076 - RNA, 9879 nt, synthetic construct
  misc_feature 1..9879: note = derived and/or modified CDS sequence (opt1) from DENV-1__GQ868510__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcggccaccgccgggagaagcgctccgtggccctggcgccccacgtggggctgggcctcgagacgcggaccgagacctggatgagctccgagggggcctggaagcagatccagcgggtcgagacctgggccctgcggcaccccggcttcacggtgatcgccctgttcctcgcgcacgccatcgggaccagcatcacccagaagggcatcatcttcatcctgctgatgctcgtgaccccctccatggccatgcgctgcgtcggcatcgggaaccgggacttcgtggagggcctgagcggggccacgtgggtggacgtcgtgctggagcacggctcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcgggtggggcaacgggtgcggcctcttcgggaagggcagcctgctgacgtgcgccaagttcaagtgcgtgaccaagctcgagggcaagatcgtgcagtacgagaacctgaagtactccgtcatcgtgaccgtgcacaccggggaccagcaccaggtcggcaacgagacgaccgagcacgggaccatcgcgaccatcacgccccaggcccccacgagcgagatccagctgaccgactacggcgccctcaccctggactgcagcccccggaccgggctggacttcaacgagatggtgctcctgacgatgaaggagaagtcctggctggtccacaagcagtggttcctcgacctgccgctgccctggacctccggcgccagcaccagccaggagacctggaaccgccaggacctcctggtgacgttcaagaccgcccacgcgaagaagcaggaggtggtcgtgctgggctcccaggagggggccatgcacaccgccctcaccggcgccacggagatccagaccagcgggaccaccacgatcttcgccggccacctgaagtgccggctgaagatggacaagctcaccctgaaggggacctcctacgtgatgtgcaccggcagcttcaagctggagaaggaggtcgcggagacgcagcacggcaccgtgctggtgcaggtcaagtacgaggggaccgacgccccctgcaagatccccttctccacccaggacgagaagggcgtgacgcagaacgggcgcctcatcaccgccaacccgatcgtgaccgacaaggagaagcccgtcaacatcgagaccgagccgcccttcggcgagagctacatcgtggtgggcgccggggagaaggcgctgaagctgtcctggttcaagaagggcagctccatcgggaagatgttcgaggccacggcccggggcgcccgccggatggccatcctcggggacaccgcgtgggacttcggcagcatcggcggggtcttcacctccgtgggcaagctggtgcaccaggtcttcgggaccgcctacggcgtgctgttcagcggggtgtcctggacgatgaagatcggcatcggcatcctcctgacctggctggggctcaacagccgctccaccagcctgtccatgacctgcatcgccgtcggcatggtgacgctgtacctcggggtgatggtccaggccgacagcggctgcgtgatcaactggaaggggcgcgagctgaagtgcggctccggcatcttcgtgaccaacgaggtccacacctggaccgagcagtacaagttccaggccgacagcccgaagcggctgagcgcggccatcgggaaggcctgggaggagggcgtgtgcgggatccgctccgccacccggctcgagaacatcatgtggaagcagatcagcaacgagctgaaccacatcctgctcgagaacgacatgaagttcacggtggtcgtgggcgacgccaacgggatcctggcgcagggcaagaagatgatccgcccccagcccatggagcacaagtactcctggaagtcctggggcaaggccaagatcatcggggccgacatccagaacaccaccttcatcatcgacggccccgacaccccggagtgccccgacatccagcgggcctggaacatctgggaggtggaggactacgggttcggcatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggggtgctggagagcgagatgatcatccccaagatctacggcgggccgatctcccagcacaactaccggcccggctacttcacccagacggccgggccctggcacctgggcaagctcgagctggacttcgacctgtgcgagggcaccaccgtcgtggtggacgagcactgcgggaaccgcggcccgagcctccggaccacgaccgtcaccgggaagatcatccacgagtggtgctgccgctcctgcaccctgccgcccctgcggttccgcggcgaggacgggtgctggtacggcatggagatccggcccgtgaaggagaaggaggagaacctcgtgcgcagcatggtctccgccggcagcggggaggtggacagcttctccctgggcatcctgtgcgccagcatcatgatcgaggaggtgatgcggtcccgctggagccggaagatgctcatgacggggaccctggccgtcttcctgctcctgatcatgggccagctgacctggaaggacctcatccgcctgtgcatcatggtgggggcgaacgcctccgaccgcatgggcatgggcaccacgtacctggccctcatggccaccttcaagatgcggccgatgttcgccgtggggctgctgttccgccggctcaccagccgcgaggtcctgctgctcaccatcggcctgtccctggtggcgagcgtggagctccccaactccctggaggagctgggggacggcctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctggggagcctgggctgcaagcccctcaccatgttcctgatcacggagaacaagatctgggggcggaagtcctggcccctgaacgagggcatcatggccatcgggatcgtcagcatcctcctgtccagcctgctcaagaacgacgtgcccctggccggcccgctgatcgccggcgggatgctcatcgcctgctacgtgatcagcggctccagcgcggacctgtccctggagaaggccgccgaggtcagctgggagcaggaggccgagcactccgggaccagccacaacatcctcgtggaggtgcaggacgacggcaccatgaagatcaaggacgaggagcgcgacgacaccctgacgatcctgctcaaggccaccctgctggcggtctccggggtgtaccccatgagcatccccgccaccctcttcgtgtggtacttctggcagaagaagaagcagcggtccggcgtcctgtgggacacccccagcccgcccgaggtggagcgcgccgtgctggacgacggcatctaccggatcctgcagcgcgggctcctgggccggtcccaggtcggggtgggcgtgttccaggacggggtcttccacacgatgtggcacgtgacccgcggcgccgtgctgatgtaccagggcaagcggctcgagcccagctgggcctccgtcaagaaggacctgatcagctacgggggcgggtggcgcttccagggctcctggaacaccggggaggaggtccaggtgatcgcggtcgagcccggcaagaacccgaagaacgtgcagaccacgcccggcaccttcaagacccccgagggggaggtgggcgccatcgccctggacttcaagcccgggaccagcggctccccgatcgtcaaccgggagggcaagatcgtggggctctacggcaacggggtggtcacgaccagcggcacctacgtgtccgccatcgcccaggcgaaggccagccaggaggggcccctgcccgagatcgaggacgaggtgttcaagaagcgcaacctgaccatcatggacctccacccgggcagcggcaagacgcggcgctacctgcccgccatcgtccgggaggccatcaagcgcaagctgcggaccctcatcctggcgcccacccgcgtggtggcctccgagatggccgaggccctgaaggggatgcccatccgctaccagaccacggccgtcaagagcgagcacaccggccgggagatcgtggacctcatgtgccacgcgaccttcaccatgcgcctgctgtccccggtgcgggtccccaactacaacatgatcatcatggacgaggcccacttcacggaccccgccagcatcgccgcccgcgggtacatctccacccgggtgggcatgggggaggcggccgccatcttcatgaccgccacgccgcccggcagcgtggaggccttcccccagtccaacgcggtcatccaggacgaggagcgcgacatccccgagcggagctggaactccggctacgactggatcacggacttccccgggaagaccgtgtggttcgtgcccagcatcaagtccggcaacgacatcgccaactgcctccgcaagaacgggaagcgggtcatccagctgagccgcaagaccttcgacaccgagtaccagaagacgaagaacaacgactgggactacgtggtgaccaccgacatctccgagatgggcgccaacttccgggccgaccgcgtcatcgacccccggcgctgcctgaagcccgtgatcctcaaggacgggcccgagcgggtgatcctggcgggcccgatgcccgtcaccgtggccagcgccgcccagcgccggggccgcatcgggcggaaccagaacaaggagggcgaccagtacgtgtacatggggcagcccctgaacaacgacgaggaccacgcccactggacggaggcgaagatgctcctggacaacatcaacacccccgagggcatcatcccggccctgttcgagcccgagcgcgagaagtccgccgccatcgacggggagtaccgcctccggggcgaggcccgcaagaccttcgtcgagctgatgcggcgcggcgacctgcccgtgtggctcagctacaaggtcgcgtccgaggggttccagtacagcgaccggcgctggtgcttcgacggcgagcggaacaaccaggtgctggaggagaacatggacgtggagatctggaccaaggagggggagcgcaagaagctgcggccccgctggctcgacgcccggacctactccgacccgctggccctgcgcgagttcaaggagttcgccgccggccggcgcagcgtcagcggcgacctcatcctggagatcgggaagctgccccagcacctcacgctgcgggcgcagaacgccctggacaacctcgtgatgctgcacaactccgagcagggcgggaaggcctaccgccacgccatggaggagctgcccgacaccatcgagaccctcatgctgctggcgctcatcgccgtgctgaccggcggggtcacgctgttcttcctcagcggcaagggcctggggaagacctccatcggcctgctctgcgtgaccgccagctccgccctgctgtggatggccagcgtggagccccactggatcgcggcctccatcatcctcgagttcttcctgatggtcctgctcatcccggagcccgaccggcagcgcacgccccaggacaaccagctggcctacgtggtgatcgggctcctgttcatgatcctgacggtcgccgccaacgagatgggcctgctcgagaccaccaagaaggacctggggatcggccacgtggcggccgagaaccaccagcacgccaccatgctggacgtggacctccggccggccagcgcctggacgctgtacgcggtcgccaccaccgtgatcacccccatgatgcgccacacgatcgagaacaccaccgccaacatctccctgaccgccatcgccaaccaggcggccatcctcatgggcctggacaaggggtggcccatcagcaagatggacatcggcgtgcccctgctcgccctggggtgctactcccaggtcaacccgctgacgctcaccgccgcggtgctgatgctggtggcccactacgccatcatcggccccgggctccaggccaaggccacccgggaggcgcagaagcgcaccgccgccggcatcatgaagaaccccacggtcgacggcatcgtggccatcgacctggaccccgtggtctacgacgccaagttcgagaagcagctggggcagatcatgctcctgatcctgtgcaccagccagatcctcctgatgcgcaccacctgggcgctgtgcgagtccatcacgctcgccaccggcccgctgaccaccctgtgggaggggagccccggcaagttctggaacacgaccatcgccgtgtccatggccaacatcttccggggcagctacctcgccggggcgggcctggccttctccctgatgaagtccctcgggggcgggcgccggggcaccggcgcccagggggagaccctgggcgagaagtggaagcgccagctgaaccagctctccaagagcgagttcaacacgtacaagcggagcgggatcatggaggtggaccgctccgaggccaaggagggcctgaagcgcggggagaccaccaagcacgcggtcagccgcggcaccgccaagctgcggtggttcgtggagcgcaacctggtgaagcccgagggcaaggtcatcgacctcgggtgcggccgcgggggctggtcctactactgcgccgggctgaagaaggtgaccgaggtgaagggctacacgaagggcgggcccggccacgaggagccgatccccatggccacctacgggtggaacctggtcaagctccacagcggcaaggacgtgttcttcatgccgcccgagaagtgcgacaccctgctgtgcgacatcggggagtccagcccgaaccccaccatcgaggagggccgcacgctccgggtgctgaagatggtcgagccctggctgcgcggcaaccagttctgcatcaagatcctcaacccctacatgccgtccgtggtggagaccctggagcagatgcagcggaagcacgggggcatgctggtccgcaaccccctcagccggaactccacccacgagatgtactgggtgagctgcgggaccggcaacatcgtgtccgccgtcaacatgacgagccgcatgctgctgaaccggttcaccatggcgcaccgcaagcccacctacgagcgcgacgtggacctcggcgccgggacccggcacgtggccgtcgagcccgaggtggccaacctggacatcatcggccagcgcatcgagaacatcaagaacgagcacaagtccacgtggcactacgacgaggacaacccgtacaagacctgggcctaccacgggagctacgaggtgaagccctccggcagcgcgtccagcatggtcaacggggtggtgcggctgctcaccaagccctgggacgtcatccccatggtgacccagatcgccatgacggacaccaccccgttcggccagcagcgcgtcttcaaggagaaggtggacacccggacgccccgcgccaagcggggcaccacccagatcatggaggtgaccgccaagtggctgtgggggttcctgtcccgcaacaagaagccccggatctgcacgcgcgaggagttcacccggaaggtccgcagcaacgccgcgatcggcgccgtgttcgtggacgagaaccagtggaacagcgccaaggaggccgtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaagggctcccgggccatctggtacatgtggctcggggcccgcttcctggagttcgaggccctgggcttcatgaacgaggaccactggttcagccgggagaactccctcagcggggtcgagggcgaggggctgcacaagctgggctacatcctccgcgacatctccaagatcccgggcgggaacatgtacgcggacgacaccgccggctgggacacgcggatcaccgaggacgacctgcagaacgaggccaagatcaccgacatcatggagcccgagcacgccctgctcgccaccagcatcttcaagctgacgtaccagaacaaggtggtgcgcgtccagcgccccgcgaagaacgggaccgtgatggacgtgatctcccggcgcgaccagcggggcagcggccaggtcgggacctacggcctgaacaccttcacgaacatggaggtgcagctcatccgccagatggagtccgaggggatcttcctgcccagcgagctggagaccccgaacctcgccgagcgggtgctggactggctgggcaagcacggggccgagcgcctcaagcggatggccatctccggcgacgactgcgtcgtgaagcccatcgacgaccgcttcgccaccgcgctgaccgccctgaacgacatgggcaaggtgcggaaggacatcccccagtgggagcccagcaaggggtggaacgactggcagcaggtcccgttctgctcccaccacttccaccagctcatcatgaaggacggccgcgagatcgtggtgccctgccggaaccaggacgagctggtcgggcgcgcccgggtgagccagggcgccgggtggtccctgcgcgagaccgcctgcctcggcaagagctacgcgcagatgtggcagctgatgtacttccaccggcgcgacctgcggctcgccgccaacgccatctgctccgcggtgcccgtcgactgggtgcccacgagccgcaccacctggagcatccacgcccaccaccagtggatgaccacggaggacatgctgtccgtgtggaaccgggtctggatcgaggagaacccgtggatggaggacaagacccacgtgagctcctgggaggaggtgccctacctgggcaagcgcgaggaccagtggtgcgggagcctcatcggcctgaccgcccgcgccacctgggccacgaacatccaggtcgcgatcaaccaggtgcggcgcctgatcgggaacgagaactacctcgactacatgacctccatgaagcggttcaagaacgagagcgaccccgagggcgccctgtggtga

SEQ ID NO: 8077 - RNA, 9879 nt, synthetic construct
  misc_feature 1..9879: note = derived and/or modified CDS sequence (opt1) from DENV-1__GQ868511__SS-prME
  source 1..9879: mol_type = other RNA
agcgtgaccatgctgctcatgctgctgcccaccgccctcgccttccacctgacgacccggggcggggagccccacatgatcgtgagcaagcaggagcggggcaagagcctcctgttcaagaccagcgccggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtgacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgacctgccggctgaagatggacaagctcaccctgaagggcacctcctacgtgatgtgcacggggagcttcaagctggagaaggaggtcgcggagacccagcacggcaccgtgctggtgcaggtcaagtacgagggcaccgacgccccctgcaagatccccttctccacgcaggacgagaagggggtgacccagaacggccgcctcatcaccgccaacccgatcgtgaccgacaaggagaagcccgtcaacatcgagacggagccgcccttcggggagagctacatcgtggtgggcgccggcgagaaggcgctgaagctgtcctggttcaagaaggggagctccatcggcaagatgttcgaggccaccgcccgcggggcccgccggatggccatcctcggcgacaccgcgtgggacttcgggagcatcggcggcgtcttcacctccgtggggaagctggtgcaccaggtcttcggcacggcctacggggtgctgttcagcggcgtgtcctggaccatgaagatcgggatcggcatcctcctgacctggctgggcctcaacagccgctccaccagcctgtccatgacgtgcatcgccgtcgggatggtgaccctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacgcggctcgagaacatcatgtggaagcagatcagcaacgagctgaaccacatcctgctcgagaacgacatgaagttcaccgtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacacgccggagtgccccgacaaccagcgggcctggaacatctgggaggtggaggactacggcttcgggatcttcaccaccaacatctggctgaagctccgcgactcctacacccagatgtgcgaccaccggctgatgagcgcggccatcaaggactccaaggccgtccacgccgacatgggctactggatcgagagcgagaagaacgagacgtggaagctggcccgcgcgtccttcatcgaggtgaagacctgcacctggcccaagagccacaccctctggtccaacggcgtgctggagagcgagatgatcatccccaagatctacgggggcccgatctcccagcacaactaccggcccgggtacttcacgcagaccgccggcccctggcacctggggaagctcgagctggacttcgacctgtgcgagggcaccaccgtcgtggtggacgagcactgcggcaaccgcgggccgagcctccggacgaccaccgtcaccggcaagatcatccacgagtggtgctgccgctcctgcacgctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgaccggcaccctggccgtcttcctgctcctggtgatggggcagctgacctggaacgacctcatccgcctgtgcatcatggtgggcgcgaacgcctccgaccgcatggggatgggcacgacctacctggccctcatggccaccttcaagatgcggccgatgttcgccgtcggcctgctgttccgccggctcaccagccgcgaggtgctgctgctcacgatcgggctgtccctggtggcgagcgtcgagctccccaactccctggaggagctgggcgacgggctcgccatgggcatcatgatgctgaagctgctcaccgagttccagccccaccagctgtggaccaccctgctcagcctgacgttcatcaagaccaccctgtccctcgactacgcctggaagaccacggccatggcgctgagcatcgtgtccctgttccccctctgcctgagcaccacctcccagaagaccacctggctgccggtcctcctgggcagcttcgggtgcaagcccctgacgatgttcctcatcaccgagaacaagatctggggccggaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggtccagcgcggacctctccctggagaaggccgccgaggtgagctgggagcaggaggccgagcactccggcaccagccacaacatcctggtggaggtccaggacgacgggaccatgaagatcaaggacgaggagcgcgacgacacgctcaccatcctgctgaaggccaccctcctggcggtgtccggcgtgtaccccatgagcatccccgccaccctgttcgtctggtacttctggcagaagaagaagcagcggtccggggtgctctgggacacgcccagcccgcccgaggtggagcgcgccgtcctggacgacggcatctaccggatcctgcagcgcggcctgctcgggcggtcccaggtgggcgtgggggtcttccaggacggcgtgttccacaccatgtggcacgtgacccgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgcggtggagcccgggaagaacccgaagaacgtgcagacgacccccggcaccttcaagacccccgagggcgaggtcggggccatcgccctggacttcaagcccggcacgagcgggtccccgatcgtgaaccgggagggcaagatcgtgggcctgtacgggaacggcgtcgtgaccaccagcgggacctacgtgtccgccatcgcccaggcgaaggccagccaggagggccccctccccgagatcgaggacgaggtcttcaagaagcgcaacctgacgatcatggacctgcacccggggagcggcaagacccggcgctacctccccgccatcgtgcgggaggccatcaagaagaagctgcgcaccctgatcctcgcgcccacccgggtggtcgcctccgagatggccgaggccctgaagggcatgcccatccgctaccagacgaccgccgtcaagagcgagcacaccgggcgcgagatcgtggacctgatgtgccacgcgaccttcacgatgcggctcctgtccccggtccgcgtgcccaactacaacatgatcatcatggacgaggcccacttcaccgaccccgccagcatcgccgcccggggctacatctccacccgcgtggggatgggcgaggcggccgccatcttcatgaccgccacgcccccggggagcgtcgaggccttcccccagtccaacgcggtgatccaggacgaggagcgggacatccccgagcgcagctggaactccggctacgactggatcaccgacttccccggcaagaccgtgtggttcgtcccgagcatcaagtccgggaacgacatcgccaactgcctgcggaagaacggcaagcgcgtgatccagctcagccggaagaccttcgacacggagtaccagaagaccaagaacaacgactgggactacgtggtcaccaccgacatctccgagatgggggccaacttccgcgccgaccgggtgatcgacccccgccggtgcctgaagcccgtgatcctgaaggacggccccgagcgcgtcatcctcgcggggccgatgcccgtgacggtggccagcgccgcccagcggcgcggccggatcggccgcaaccagaacaaggagggggaccagtacgtctacatgggccagcccctgaacaacgacgaggaccacgcccactggaccgaggcgaagatgctgctcgacaacatcaacacccccgaggggatcatcccggccctgttcgagcccgagcgggagaagtccgccgccatcgacggcgagtaccgcctgcgcggggaggcccggaagaccttcgtggagctcatgcgccggggcgacctgcccgtctggctgagctacaaggtggcgtccgagggcttccagtacagcgaccgccggtggtgcttcgacggggagcgcaacaaccaggtgctcgaggagaacatggacgtcgagatctggaccaaggagggcgagcggaagaagctgcgcccccggtggctggacgcccgcacgtactccgacccgctcgccctgcgggagttcaaggagttcgccgccgggcgccggagcgtgagcggcgacctgatcctcgagatcggcaagctgccccagcacctgaccctccgcgcgcagaacgccctggacaacctggtgatgctccacaactccgagcagggcgggaaggcctaccggcacgccatggaggagctgcccgacaccatcgagaccctgatgctcctggcgctgatcgccgtcctcaccggcggggtgaccctgttcttcctgagcgggaaggggctcggcaagacctccatcgggctgctgtgcgtgaccgccagctccgccctcctgtggatggccagcgtcgagccccactggatcgcggcctccatcatcctggagttcttcctcatggtgctgctgatcccggagcccgaccgccagcggacgccccaggacaaccagctcgcctacgtggtcatcggcctgctgttcatgatcctcaccgtggccgccaacgagatggggctgctggagaccaccaagaaggacctcggcatcgggcacgtggcggccgagaaccaccagcacgccacgatgctggacgtcgacctgcgcccggccagcgcctggaccctctacgcggtggccaccaccgtgatcacgcccatgatgcggcacaccatcgagaacaccaccgccaacatctccctgacggccatcgccaaccaggcggccatcctgatgggcctcgacaagggctggcccatcagcaagatggacatcggggtccccctgctggccctcggctgctactcccaggtgaacccgctgaccctgaccgccgcggtgctcatgctggtcgcccactacgccatcatcgggcccggcctgcaggccaaggccacccgcgaggcgcagaagcggacggccgccgggatcatgaagaaccccaccgtggacggcatcgtggccatcgacctcgaccccgtcgtgtacgacgccaagttcgagaagcagctgggccagatcatgctgctcatcctgtgcaccagccagatcctgctcatgcgcaccacgtgggcgctgtgcgagtccatcaccctggccaccgggccgctcaccacgctgtgggagggcagccccgggaagttctggaacaccaccatcgccgtgtccatggccaacatcttccgcggcagctacctggccggcgcggggctcgccttctccctgatgaagtccctgggcgggggccggcgcgggaccggcgcccagggcgagacgctcggggagaagtggaagcggcagctgaaccagctgtccaagagcgagttcaacgcctacaagcgcagcggcatcatggaggtcgaccggtccgaggcgaaggaggggctcaagcgcggcgagaccaccaagcacgccgtgagccgggggaccgccaagctgcgctggttcgtggagcggaacctggtcaagcccgagggcaaggtgatcgacctgggctgcgggcgcggcgggtggtcctactactgcgccggcctcaagaaggtgaccgaggtcaaggggtacacgaagggcggccccgggcacgaggagccgatccccatggccacctacggctggaacctggtgaagctgcacagcgggaaggacgtgttcttcatgccgcccgagaagtgcgacaccctcctgtgcgacatcggcgagtccagcccgaaccccaccatcgaggaggggcggacgctgcgcgtcctcaagatggtggagccctggctgcggggcaaccagttctgcatcaagatcctgaacccctacatgccgtccgtggtcgagaccctcgagcagatgcagcgcaagcacggcgggatgctggtgcggaaccccctgagccgcaactccacccacgagatgtactgggtgagctgcggcaccgggaacatcgtctccgcggtgaacatgacgagccggatgctcctgaaccgcttcaccatggcccaccggaagcccacctacgagcgcgacgtggacctgggcgccggcacccgccacgtcgccgtggagcccgaggtggccaacctcgacatcatcgggcagcggatcgagaacatcaagaacgagcacaagtccacgtggcactacgacgaggacaacccgtacaagacctgggcgtaccacggcagctacgaggtcaagccctccgggagcgcctccagcatggtgaacggcgtggtccgcctgctgaccaagccctgggacgtgatccccatggtcacccagatcgccatgacggacaccaccccgttcgggcagcagcgggtgttcaaggagaaggtggacacccgcacgccccgggccaagcgcggcaccacccagatcatggaggtcaccgccaagtggctctggggcttcctgtcccggaacaagaagccccgcatctgcacgcgggaggagttcacccgcaaggtgcggagcaacgcggccatcggggccgtgttcgtcgacgagaaccagtggaacagcgccaaggaggcggtggaggacgagtccttctgggacctggtgcacaaggagcgcgagctccacaagcagggcaagtgcgcgacctgcgtctacaacatgatggggaagcgggagaagaagctgggcgagttcgggaaggccaagggcagccgcgccatctggtacatgtggctgggcgcccggttcctcgagttcgaggcgctggggttcatgaacgaggaccactggttctcccgcgagaacagcctgtccggcgtggagggggagggcctccacaagctggggtacatcctgcgggacatcagcaagatcccgggcggcaacatgtacgccgacgacaccgccgggtgggacacgcgcatcaccgaggacgacctccagaacgaggccaagatcaccgagatcatggagcccgagcacgccctgctggcgacctccatcttcaagctcacgtaccagaacaaggtggtccgggtgcagcgccccgccaagaacggcaccgtgatggacgtcatcagccggcgcgaccagcgcgggtccggccaggtgggcacctacgggctgaacaccttcacgaacatgggcgtgcagctgatccggcagatggagagcgaggggatcttcctcccctccgagctggagaccccgaacctggccgagcgcgtcctcgactggctggagaagcacggcgccgagcggctgaagcgcatggccatcagcggggacgactgcgtggtgaagcccatcgacgaccggttcgcgaccgccctcaccgccctgaacgacatgggcaaggtccgcaaggacatcccccagtgggagccctccaagggctggaacgactggcagcaggtcccgttctgcagccaccacttccaccagctgatcatgaaggacgggcgggagatcgtggtcccctgccgcaaccaggacgagctcgtgggccgggcccgcgtgtcccagggggccggctggagcctgcgggagaccgcgtgcctggggaagtcctacgcccagatgtggcagctcatgtacttccaccgccgggacctgcgcctggccgccaacgcgatctgcagcgccgtccccgtggactgggtgcccacgagccggaccacctggtccatccacgcccaccaccagtggatgaccacggaggacatgctcagcgtctggaaccgcgtgtggatcgaggagaacccgtggatggaggacaagacccacgtgtccagctgggaggaggtcccctacctgggcaagcgggaggaccagtggtgcggctccctgatcgggctcaccgcccgcgccacctgggcgacgaacatccaggtggccatcaaccaggtgcggcgcctgatcggcaacgagaactacctggactacatgaccagcatgaagcgcttcaagaacgagtccgaccccgagggggccctctggtga

SEQ ID NO: 8078 - RNA, 9879 nt, synthetic construct
  misc_feature 1..9879: note = derived and/or modified CDS sequence (opt1) from DENV-1__GQ868512__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgtgagcatcatgatcgaggaggtcatgcggtcccgctggagccggaagatgctcatgacgggcaccctggccgtgttcctgctcctggtgatggggcagctgacctggaacgacctcatccgcctgtgcatcatggtcggcgccaacgcgtccgaccgcatggggatgggcaccacgtacctggccctcatggccaccttcaagatgcggccgatgttcgccgtggggctgctgttccgccggctcaccagccgcgaggtgctgctgctcaccatcgggctgtccctggtcgccagcgtggagctccccaactccctggaggagctgggcgacgggctcgcgatgggcatcatgatgctgaagctgctcacggagttccagccccaccagctgtggaccaccctgctcagcctgaccttcatcaagacgaccctgtccctcgactacgcctggaagaccaccgccatggccctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggccgtgtccggcgtctaccccatgagcatccccgcgaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcaccagcgggtccccgatcgtgaaccgggagggcaagatcgtcggcctgtacgggaacggcgtggtgacgaccagcgggacctacgtctccgccatcgcccaggccaaggcgagccaggagggccccctccccgagatcgaggacgaggtgttcaagaagcgcaacctgaccatcatggacctgcacccggggagcggcaagacgcggcgctacctccccgccatcgtgcgggaggccatcaagcgcaagctgcggaccctgatcctcgcccccacccgcgtcgtggcgtccgagatggccgaggccctgaagggcatgcccatccgctaccagaccacggccgtcaagagcgagcacaccgggcgggagatcgtcgacctgatgtgccacgccaccttcaccatgcgcctcctgtccccggtgcgggtgcccaactacaacatgatcatcatggacgaggcgcacttcacggaccccgccagcatcgccgcccgcggctacatctccacccgggtcgggatgggcgaggccgcggccatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgcgaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgccgggccgatgcccgtgaccgtcgcgagcgccgcccagcgccggggccgcatcggccggaaccagaacaaggagggggaccagtacgtgtacatgggccagcccctgaacaacgacgaggaccacgcccactggacggaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtggcctccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcgcggacctactccgacccgctcgccctgcgcgagttcaaggagttcgccgccgggcggcgcagcgtgagcggcgacctgatcctcgagatcggcaagctgccccagcacctgacgctccgggcccagaacgcgctggacaacctggtcatgctccacaactccgagcagggcgggaaggcctaccgccacgccatggaggagctgcccgacaccatcgagaccctgatgctcctggccctgatcgcggtgctcaccgggggcgtgacgctgttcttcctgagcgggaagggcctcggcaagacctccatcgggctgctgtgcgtcaccgccagctccgccctcctgtggatggccagcgtggagccccactggatcgccgcgtccatcatcctggagttcttcctcatggtgctgctgatcccggagcccgaccggcagcgcacgccccaggacaaccagctcgcctacgtcgtgatcggcctgctgttcatgatcctcacggtggccgccaacgagatggggctgctggagaccaccaagaaggacctcggcatcgggcacgtcgccgcggagaaccaccagcacgccaccatgctggacgtggacctgcggccggccagcgcctggacgctctacgccgtggcgaccaccgtcatcacccccatgatgcgccacacgatcgagaacaccaccgccaacatctccctgaccgccatcgccaaccaggccgcgatcctgatgggcctcgacaagggctggcccatcagcaagatggacatcggggtgcccctgctggccctcggctgctactcccaggtgaacccgctgacgctgaccgccgccgtcctcatgctggtggcgcactacgccatcatcgggcccggcctgcaggccaaggccacccgggaggcccagaagcgcaccgcggccgggatcatgaagaaccccacggtggacggcatcgtcgccatcgacctcgaccccgtggtgtacgacgccaagttcgagaagcagctgggccagatcatgctgctcatcctgtgcaccagccagatcctgctcatgcgcaccacctgggccctgtgcgagtccatcacgctggcgaccgggccgctcaccaccctgtgggagggcagccccgggaagttctggaacacgaccatcgccgtctccatggccaacatcttccggggcagctacctggccggcgccgggctcgcgttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgccgtgagccgcgggaccgcgaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacacgaagggcggccccgggcacgaggagccgatccccatggccacctacggctggaacctggtgaagctgcacagcgggaaggacgtcttcttcatgccgcccgagaagtgcgacaccctcctgtgcgacatcggcgagtccagcccgaaccccaccatcgaggaggggcgcacgctgcgggtgctcaagatggtggagccctggctgcgcggcaaccagttctgcatcaagatcctgaacccctacatgccgtccgtcgtggaggccctcgagcagatgcagcggaagcacggcgggatgctggtgcgcaaccccctgagccggaactccacccacgagatgtactgggtcagctgcggcaccgggaacatcgtgtccgccgtgaacatgaccagccgcatgctcctgaaccggttcacgatggcgcaccgcaagcccacctacgagcgcgacgtcgacctgggcgccggcacccggcacgtggccgtggagcccgaggtcgccaacctcgacatcatcgggcagcgcatcgagaacatcaagaacgagcacaagtccacctggcactacgacgaggacaacccgtacaagacgtgggcctaccacggcagctacgaggtgaagccctccgggagcgcgtccagcatggtgaacggcgtcgtgcggctgctgaccaagccctgggacgtcatccccatggtgacccagatcgccatgaccgacacgaccccgttcgggcagcagcgcgtgttcaaggagaaggtcgacacccggacgccccgggccaagcggggcacgacccagatcatggaggtgaccgccaagtggctctggggcttcctgtcccgcaacaagaagccccggatctgcacccgcgaggagttcacgcggaaggtgcgcagcaacgccgcgatcggggccgtcttcgtggacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacaccgccgggtgggacacccggatcacggaggacgacctccagaacgaggccaagatcaccgagatcatggagcccgagcacgccctgctggccaccagcatcttcaagctcacctaccagaacaaggtcgtgcgcgtgcagcgccccgcgaagaacggcacggtcatggacgtgatctcccggcgcgaccagcgggggagcggccaggtgggcacctacgggctgaacaccttcaccaacatggaggtccagctgatccgccagatggagtccgagggcatcttcctccccagcgagctggagacgccgaacctggccgagcgggtgctcgactggctggagaagcacggggccgagcgcctgaagcggatggccatctccggcgacgactgcgtggtcaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctcgtggggcgcgcccgggtcagccagggcgccgggtggtccctgcgcgagaccgcctgcctgggcaagagctacgcgcagatgtggcagctcatgtacttccaccggcgcgacctgcggctggccgccaacgccatctgctccgcggtgcccgtggactgggtccccaccagccgcacgacctggagcatccacgcccaccaccagtggatgaccaccgaggacatgctctccgtgtggaaccgggtgtggatcgaggagaacccgtggatggaggacaagacgcacgtcagctcctgggaggaggtgccctacctggggaagcgcgaggaccagtggtgcggcagcctgatcggcctcaccgcccgcgccacctgggccaccaacatccaggtggcgatcaaccaggtccggcgcctgatcgggaacgagaactacctggactacatgacgtccatgaagcggttcaagaacgagagcgaccccgagggcgccctctggtga

SEQ ID NO: 8079 - RNA, 9879 nt, synthetic construct
  misc_feature 1..9879: note = derived and/or modified CDS sequence (opt1) from DENV-1__GU131970__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtgacctacgggacctgcagccagaccggcgagcaccgccgggagaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagaccatccgcccccagcccatggagcacaagtactcctggaagtcctggggcaaggccaagatcatcggcgccgacatccagaacaccaccttcatcatcgacgggcccgacacgccggagtgccccgacaaccagcgggcctggaacatctgggaggtggaggactacggcttcgggatcttcaccaccaacatctggctgaagctccgcgactcctacacccagatgtgcgaccaccggctgatgagcgcggccatcaaggactccaaggccgtccacgccgacatgggctactggatcgagagcgagaagaacgagacgtggaagctggcccgcgcgtccttcatcgaggtgaagacctgcacctggcccaagagccacaccctctggtccaacggcgtgctggagagcgagatgatcatccccaagatctacgggggcccgatctcccagcacaactaccggcccgggtacttcacgcagaccgccggcccctggcacctggggaagctcgagctggacttcgacctgtgcgagggcaccaccgtcgtggtggacgagcactgcggcaaccgcgggccgagcctccggacgaccaccgtcaccggcaagatcatccacgagtggtgctgccgctcctgcacgctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgtgagcatcatgatcgaggaggtcatgcggtcccgctggagccggaagatgctcatgaccggcaccctggccgtgttcctgctcctgatcatggggcagctgacctggaaggacctcatccgcctgtgcatcatggtgggcgccaacgcgtccgaccgcatggggatgggcacgacctacctggccctcatggccaccttcaagatgcggccgatgttcgccgtcggcctgctgttccgccggctcaccagccgcgaggtgctgctgctcacgatcgggctgtccctggtggccagcgtcgagctccccaactccctggaggagctgggcgacgggctcgcgatgggcatcatgatgctgaagctgctcaccgagttccacccccaccagctgtggaccaccctgctcagcctgacgttcatcaagaccaccctgtccctcgactacgcctggaagaccacggccatggccctgagcatcgtgtccctgttccccctctgcctgagcaccacctcccagaagaccacctggctgccggtcctcctgggcagcttcgggtgcaagcccctgacgatgttcctcatcaccgagaacaagatctggggccggaagtcctggcccctgaacgaggggatcatggcgatcggcatcgtgagcatcctgctctccagcctgctgaagaacgacgtgcccctcgccgggccgctgatcgccggcggcatgctgatcgcctgctacgtcatcagcgggtccagcgccgacctctccctggagaaggcggccgaggtgagctgggagcaggaggccgagcactccggcaccagccacaacatcctggtggaggtccaggacgacgggaccatgaagatcaaggacgaggagcgcgacgacacgctcaccatcctgctgaaggccaccctcctggccgtgtccggcgtgtaccccatgagcatccccgcgaccctgttcgtctggtacttctggcagaagaagaagcagcggtccggggtgctctgggacacgcccagcccgcccgaggtggagcgcgccgtcctggacgacggcatctaccggatcctgcagcgcggcctgctcgggcggtcccaggtgggcgtgggggtcttccaggacggcgtgttccacaccatgtggcacgtgacccgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgccgtggagcccgggaagaacccgaagaacgtgcagacgacccccggcaccttcaagacccccgagggcgaggtcggggcgatcgccctggacttcaagcccggcacgagcgggtccccgatcgtgaaccgggagggcaagatcgtgggcctgtacgggaacggcgtcgtgaccaccagcgggacctacgtgtccgccatcgcccaggccaaggcgagccaggagggccccctccccgagatcgaggacgaggtcttcaagaagcgcaacctgacgatcatggacctgcacccggggagcggcaagacccggcgctacctccccgccatcgtgcgggaggccatcaagcgcaagctgcggaccctgatcctcgcccccacccgcgtggtcgcgtccgagatggccgaggccctgaagggcatgcccatccgctaccagacgaccgccgtcaagagcgagcacaccgggcgggagatcgtggacctgatgtgccacgccaccttcacgatgcgcctcctgtccccggtccgggtgcccaactacaacatgatcatcatggacgaggcgcacttcaccgaccccgccagcatcgccgcccgcggctacatctccacccgggtggggatgggcgaggccgcggccatcttcatgaccgccacgcccccggggagcgtcgaggccttcccccagtccaacgccgtgatccaggacgaggagcgcgacatccccgagcggagctggaactccggctacgactggatcaccgacttccccggcaagaccgtgtggttcgtcccgagcatcaagtccgggaacgacatcgcgaactgcctgcgcaagaacggcaagcgggtgatccagctcagccgcaagaccttcgacacggagtaccagaagaccaagaacaacgactgggactacgtggtcaccaccgacatctccgagatgggggccaacttccgggccgaccgcgtgatcgacccccggcgctgcctgaagcccgtgatcctgaaggacggccccgagcgggtcatcctcgccgggccgatgcccgtgacggtggcgagcgccgcccagcgccggggccgcatcggccggaaccagaacaaggagggggaccagtacgtctacatgggccagcccctgaacaacgacgaggaccacgcccactggaccgaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcctccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcgcggacgtactccgacccgctcgccctgcgcgagttcaaggagttcgccgccgggcggcgcagcgtgagcggcgacctgatcctcgagatcggcaagctgccccagcacctgaccctccgggcccagaacgcgctggacaacctggtgatgctccacaactccgagcagggcgggaaggcctaccgccacgccatggaggagctgcccgacaccatcgagaccctgatgctcctggccctgatcgcggtcctcaccggcggggtgaccctgttcttcctgagcgggaaggggctcggcaagacctccatcgggctgctgtgcgtgaccgccagctccgccctcctgtggatggccagcgtcgagccccactggatcgccgcgtccatcatcctggagttcttcctcatggtgctgctgatcccggagcccgaccggcagcgcacgccccaggacaaccagctcgcctacgtggtcatcggcctgctgttcatgatcctcaccgtggccgccaacgagatggggctgctggagaccaccaagaaggacctcggcatcgggcacgtggccgcggagaaccaccagcacgccacgatgctggacgtcgacctgcggccggccagcgcctggaccctctacgccgtggcgaccaccgtgatcacgcccatgatgcgccacaccatcgagaacaccaccgccaacatctccctgacggccatcgccaaccaggccgcgatcctgatgggcctcgacaagggctggcccatcagcaagatggacatcggggtccccctgctggccctcggctgctactcccaggtgaacccgctgaccctgaccgccgccgtgctcatgctggtcgcgcactacgccatcatcgggcccggcctgcaggccaaggccacccgggaggcccagaagcgcacggcggccgggatcatgaagaaccccaccgtggacggcatcgtggccatcgacctcgaccccgtcgtgtacgacgccaagttcgagaagcagctgggccagatcatgctgctcatcctgtgcaccagccagatcctgctcatgcgcaccacgtgggccctgtgcgagtccatcaccctggcgaccgggccgctcaccacgctgtgggagggcagccccgggaagttctggaacaccaccatcgccgtgtccatggccaacatcttccggggcagctacctggccggcgccgggctcgcgttctccctgatgaagtccctgggcgggggccgccgggggaccggcgcccagggcgagacgctcggggagaagtggaagcgccagctgaaccagctgtccaagagcgagttcaacacctacaagcggagcggcatcatggaggtcgaccgctccgaggccaaggaggggctcaagcggggcgagaccaccaagcacgccgtgagccgcgggaccgcgaagctgcggtggttcgtggagcgcaacctggtcaagcccgagggcaaggtgatcgacctgggctgcgggcggggcgggtggtcctactactgcgccggcctcaagaaggtgacggaggtcaaggggtacaccaagggcggccccgggcacgaggagccgatccccatggccacctacggctggaacctggtgaagctgcacagcgggaaggacgtgttcttcatgccgcccgagaagtgcgacaccctcctgtgcgacatcggcgagtccagcccgaaccccacgatcgaggaggggcgcaccctgcgggtcctcaagatggtggagccctggctgcgcggcaaccagttctgcatcaagatcctgaacccctacatgccgtccgtggtcgagaccctcgagcagatgcagcggaagcacggcgggatgctggtgcgcaaccccctgagccggaactccacccacgagatgtactgggtgagctgcggcacggggaacatcgtctccgccgtgaacatgaccagccgcatgctcctgaaccggttcaccatggcccaccgcaagcccacctacgagcgcgacgtggacctgggcgcgggcacgcggcacgtcgccgtggagcccgaggtggccaacctcgacatcatcgggcagcgcatcgagaacatcaagaacgagcacaagtccacctggcactacgacgaggacaacccgtacaagacctgggcctaccacggcagctacgaggtcaagccctccgggagcgcctccagcatggtgaacggcgtggtccggctgctgaccaagccctgggacgtgatccccatggtcacgcagatcgcgatgaccgacaccaccccgttcgggcagcagcgcgtgttcaaggagaaggtggacacgcggacgccccgggccaagcggggcaccacccagatcatggaggtcacggccaagtggctctggggcttcctgtcccgcaacaagaagccccggatctgcacccgcgaggagttcacccggaaggtgcgcagcaacgccgccatcggggcggtgttcgtcgacgagaaccagtggaacagcgccaaggaggccgtggaggacgagcggttctgggacctggtgcaccgcgagcgggagctccacaagcagggcaagtgcgcgacctgcgtctacaacatgatggggaagcgcgagaagaagctgggcgagttcgggaaggcgaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgccgacgacacggcggggtgggacacccggatcaccgaggacgacctccagaacgaggccaagatcaccgacatcatggagcccgagcacgccctgctggccacgagcatcttcaagctcacctaccagaacaaggtggtccgcgtgcagcgccccgccaagaacggcaccgtgatggacgtcatctcccggcgcgaccagcgggggagcggccaggtgggcacctacgggctgaacacgttcaccaacatggaggtgcagctgatccgccagatggagtccgagggcatcttcctccccagcgagctggagaccccgaacctggcggagcgggtcctcgactggctggagaagcacggggccgagcgcctgaagcggatggccatctccggcgacgactgcgtggtgaagcccatcgacgaccgcttcgccaccgccctcaccgcgctgaacgacatggggaaggtccggaaggacatcccccagtgggagcccagcaagggctggaacgactggcagcaggtcccgttctgctcccaccacttccaccagctgatcatgaaggacggccgcgagatcgtggtcccctgccggaaccaggacgagctcgtggggcgcgcccgggtgagccagggcgccgggtggtccctgaaggagacggcctgcctgggcaagagctacgcccagatgtggcagctcatgtacttccaccgccgggacctgcgcctggcggccaacgccatctgctccgccgtccccgtggactgggtgcccaccagccggaccacctggagcatccacgcgcaccaccagtggatgacgaccgaggacatgctctccgtctggaaccgcgtgtggatcgaggagaacccgtggatggaggacaagacccacgtgagctcctgggaggaggtcccctacctggggaagcgggaggaccagtggtgcggcagcctgatcggcctcaccgcccgcgccacgtgggccaccaacatccaggtggccatcaaccaggtgcgccggctgatcgggaacgagaactacctggactacatgacctccatgaagcgcttcaagaacgagagcgaccccgagggcgcgctctggtga

SEQ ID NO: 8080 - RNA, 9879 nt, synthetic construct
  misc_feature 1..9879: note = derived and/or modified CDS sequence (opt1) from DENV-1__KF955427__SS-prME
  source 1..9879: mol_type = other RNA
agcgtgaccatgctgctcatgctgctgcccaccgcgctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacgcggaccgagacctggatgagcagcgagggcgcctggaagcagatccagcgggtggagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgcccctgccctggacctccggggccagcaccagccaggagacctggaaccgccaggacctcctggtgacgttcaagaccgcccacgcgaagaagcaggaggtggtcgtgctgggctcccaggagggcgccatgcacaccgcctggaccggggccacggagatccagaccagcggcaccaccacgatcttcgccgggcacctcaagtggcggctgaagatggacaagctgaccctcaagggcacctcctacgtgatgtgcaccgggagcttcaagctggagaaggaggtcgcggagacgcagcacggcaccggcctggtccaggtgaagtacgaggggaccgacgccccctgcaagatccccttctccgcccaggacgagaagggcgtcacccagaacgggcgcctgatcacggccaacccgatcgtgaccgacaaggagaagcccgtgaacatcgagaccgagccgcccttcggcgagagctacatcgtcgtgggcgcgggggagaaggccctcaagctgtcctggttcaagaagggcagctccatcgggaagatgttcgaggccaccgcccggggcgcccgccggatggcgatcctgggggacacggcctgggacttcggcagcatcggcggggtgttcacctccgtcggcaagctcgtgcaccaggtgttcgggaccgcctacggcgtcctgttcagcggggtgtcctggaccatgaagatcggcatcggcatcctgctcacgtggctggggctgaacagccgctccaccagcctctccatgacctgcatcgccgtgggcatggtcaccctgtacctgggggtgatggtgcaggccgacagcggctgcgtcatcaactggaaggggcgcgagctcaagtgcggctccggcatcttcgtgacgaacgaggtgcacacctggaccgagcagtacaagttccaggcggacagcccgaagcggctgagcgccgccatcgggaaggcctgggaggagggcgtctgcgggatccgctccgccacccggctggagaacatcatgtggaagcagatcagcaacgagctcaaccacatcctgctggagaacgacatgaagttcaccgtggtggtcggcgacgcgaacgggatcctcgcccagggcaagaagatgatccgcccccagcccatggagcacaagtactcctggaagtcctggggcaaggccaagatcatcggggccgacatccagaacacgaccttcatcatcgacggccccgacaccccggagtgccccgacaaccagcgggcgtggaacatctgggaggtggaggactacgggttcggcatcttcaccacgaacatctggctgaagctgcgcgactcctacacccagatgtgcgaccaccggctcatgagcgccgccatcaaggactccaaggccgtgcacgccgacatgggctactggatcgagagcgagaagaacgagacctggaagctggcgcgcgcctccttcatcgaggtcaagacctgcacgtggcccaagagccacaccctgtggtccaacggggtgctcgagagcgagatgatcatccccaagatctacggcgggccgatctcccagcacaactaccggcccggctacttcacccagaccgccgggccctggcacctgggcaagctggagctcgacttcgacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgccagcatcatgatcgaggaggtgatgcggtcccgctggagccggaagatgctgatgaccgggacgctcgcggtgttcctgctgctcgtcatgggccagctgacctggaacgacctgatccgcctctgcatcatggtgggggccaacgcctccgaccgcatgggcatgggcaccacctacctggccctgatggccacgttcaagatgcggccgatgttcgcggtggggctcctgttccgccggctgaccagccgcgaggtcctcctgctgaccatcggcctctccctggtggccagcgtggagctgcccaactccctcgaggagctgggggacggcctggccatgggcatcatgatgctcaagctgctgaccgagttccagccccaccagctctggacgaccctgctgagcctcaccttcatcaagaccacgctgtccctggactacgcctggaagaccaccgcgatggccctcagcatcgtctccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggccatcgggatcgtcagcatcctgctgtccagcctcctgaagaacgacgtgcccctgccggaccccctcatcgccggcggcatcctgatcgcctgctacgtgatcagcgggtccagcgcggacctgtccctcgagaaggccgccgagatgagctgggagcaggaggccgagcactccggcacgagccacaacatcctggtcgaggtgcaggacgacgggcccatgaagatcaaggacgaggagcgcgacgacaccctgaccatcctcctgaaggccaccctgctcgcggtgtccggcgtctaccccatgagcatcccggggacgctgttcgtgtggtacttctggcagaagaagaagcagcggtccggcgtgctgtgggacaccccctccccgcccaaggtcgagcgcgccgtgctcgacgacggcatctaccggatcctgcagcgcgggctgctgggccggtcccaggtgggggtcggcgtgttccaggacggggtgttccacaccatgtggcacgtcacccgcggcgccgtgctcatgtaccagggcaagcggctggagccgagctgggcctccgtgaagaaggacctgatcagctacgggggcgggtggcgcttccagggctcctggaacacgggggaggaggtccaggtgatcgccgtggagcccggcaagaaccccaagaacgtccagaccacccccggcaccttcaagacgccggagggggaggtgggcgcgatcgccctcgacttcaagcccgggaccagcggctcccccatcgtgaaccgggagggcaagatcgtcgggctgtacggcaacggggtggtgaccaccagcggcacgtacgtctccgccatcgcccaggccaaggcgagccaggaggggccgctgcccgagatcgaggacgaggtgttcaagaagcgcaacctcaccatcatggacctgcaccccggcagcggcaagacccggcgctacctgcccgccatcgtgcgggaggccatcaagcgcaagctccggaccctgatcctggccccgacgcgcgtcgtggcgtccgagatggccgaggccctcaaggggatgcccatccgctaccagaccaccgccgtcaagagcgagcacaccggccgggagatcgtcgacctgatgtgccacgccacgttcaccatgcgcctgctctcccccgtgcgggtgcccaactacaacatgatcatcatggacgaggcgcacttcaccgacccggccagcatcgccgcccgcgggtacatctccacccgggtcggcatgggggaggccgcggccatcttcatgacggccacgccgcccggcagcgtggaggccttcccccagtccaacgccgtgatccaggacgaggagcgcgacatcccggagcggagctggaactccggctacgactggatcaccgacttccccgggaagaccgtctggttcgtgcccagcatcaagtccggcaacgacatcgcgaactgcctgcgcaagaacgggaagcgggtgatccagctgagccgcaagacgttcgacaccgagtaccagaagaccaagaacaacgactgggactacgtcgtgaccacggacatctccgagatgggcgccaacttccgggccgaccgcgtgatcgacccccggcgctgcctcaagccggtcatcctgaaggacgggcccgagcgggtgatcctggccggccccatgcccgtgaccgtcgcgagcgccgcccagcgccggggccgcatcgggcggaaccagaacaaggagggcgaccagtacgtgtacatggggcagccgctcaacaacgacgaggaccacgcccactggaccgaggccaagatgctgctggacaacatcaacacccccgagggcatcatccccgccctcttcgagcccgagcgcgagaagtccgccgccatcgacggggagtaccgcctgcggggcgaggcccgcaagacgttcgtggagctgatgcggcgcggcgacctcccggtctggctgagctacaaggtggcctccgaggggttccagtacagcgaccggcgctggtgcttcgacggcgagcggaacaaccaggtcctggaggagaacatggacgtggagatctggaccaaggagggggagcgcaagaagctccggccccgctggctggacgcgcggacctactccgaccccctggccctccgcgagttcaaggagttcgccgccggccggcgcagcatcagcggcgacctgatcctggagatcgggaagctcccccagcacctgaccctgcgggcccagaacgcgctcgacaacctggtgatgctgcacaactccgagcagggcgggaaggcctaccgccacgccatggaggagctcccggacaccatcgagacgctgatgctgctcgccctgatcgcggtcctgaccggcggggtgaccctcttcttcctgagcggcaagggcctggggaagacctccatcggcctcctgtgcgtgacggccagctccgccctgctctggatggccagcgtcgagccccactggatcgccgcgtccatcatcctggagttcttcctgatggtgctcctgatccccgagccggaccggcagcgcacgccccaggacaaccagctggcctacgtggtcatcgggctcctgttcatgatcctgaccgtggccgccaacgagatgggcctcctggagaccacgaagaaggacctggggatcggccacgtggccgcggagaaccaccagcacgccaccatgctcgacgtcgacctgcggcccgccagcgcctggaccctgtacgccgtggcgaccacggtgatcacccccatgatgcgccacaccatcgagaacaccacggccaacatctccctcaccgccatcgccaaccaggccgcgatcctgatgggcctggacaaggggtggccgatcagcaagatggacatcggcgtccccctcctggccctggggtgctactcccaggtgaaccccctcaccctgaccgccgccgtgctgatgctcgtcgcgcactacgccatcatcggccccgggctgcaggccaaggccacgcgggaggcccagaagcgcaccgcggccggcatcatgaagaacccgaccgtggacggcatcgtggccatcgacctggaccccgtcgtgtacgacgccaagttcgagaagcagctcgggcagatcatgctgctgatcctctgcaccagccagatcctgctgatgcgcacgacctgggccctctgcgagtccatcaccctggcgaccggccccctgacgaccctctgggaggggagccccggcaagttctggaacaccaccatcgccgtgtccatggccaacatcttccggggcagctacctggccggggccggcctggcgttctccctcatgaagtccctcgggggcgggcgccgggggacgggcgcccagggggagaccctgggcgagaagtggaagcgccagctcaaccagctgtccaagagcgagttcaacacctacaagcggagcgggatcatggaggtcgaccgctccgaggccaaggagggcctgaagcgcggggagaccacgaagcacgccgtgagccgcggcaccgcgaagctccggtggttcgtggagcgcaacctggtcaagccggagggcaaggtgatcgacctggggtgcggccgcggcgggtggtcctactactgcgccgggctgaagaaggtgaccgaggtcaaggggtacaccaagggcgggcccggccacgaggagcccatccccatggccacctacgggtggaacctcgtgaagctgcacagcggcaaggacgtgttcttcatgccgcccgagaagtgcgacacgctgctctgcgacatcggggagtccagccccaaccccaccatcgaggagggccgcaccctgcgggtcctgaagatggtggagccgtggctccgcggcaaccagttctgcatcaagatcctgaacccctacatgccctccgtggtcgagaccctggagcagatgcagcggaagcacgggggcatgctcgtgcgcaaccccctgagccggaactccacgcacgagatgtactgggtgagctgcgggaccggcaacatcgtctccgccgtgaacatgaccagccgcatgctgctcaaccggttcaccatggcccaccgcaagccgacgtacgagcgcgacgtggacctgggcgcggggacccggcacgtcgccgtggagcccgaggtggccaacctggacatcatcggccagcgcatcgagaacatcaagaacgagcacaagtccacctggcactacgacgaggacaacccctacaagacctgggcctaccacgggagctacgaggtcaagccctccggcagcgcctccagcatggtgaacggggtggtccggctcctgacgaagccgtgggacgtgatccccatggtgacccagatcgcgatgaccgacaccacgcccttcggccagcagcgcgtcttcaaggagaaggtggacacccggaccccgcgcgccaagcggggcaccacgcagatcatggaggtcaccgccaagtggctgtgggggttcctctcccgcaacaagaagccccggatctgcacccgcgaggagttcacccggaaggtgcgcagcaacgccgccatcggcgcggtgttcgtcgacgagaaccagtggaacagcgccaaggaggccgtggaggacgagcggttctgggacctggtgcaccgcgagcgggagctgcacaagcaggggaagtgcgccacgtgcgtctacaacatgatgggcaagcgcgagaagaagctcggggagttcggcaaggcgaagggctcccgggccatctggtacatgtggctgggggcccgcttcctggagttcgaggccctcggcttcatgaacgaggaccactggttcagccgggagaactccctgagcggggtggagggcgaggggctgcacaagctcggctacatcctgcgcgacatctccaagatccccggcgggaacatgtacgccgacgacaccgcgggctgggacacccggatcaccgaggacgacctgcagaacgaggccaagatcacggagatcatggagcccgagcacgccctcctggccaccagcatcttcaagctgacctaccagaacaaggtggtccgcgtgcagcgcccggccaagaacgggaccgtgatggacgtcatctcccggcgcgaccagcggggcagcggccaggtggggacgtacggcctcaacaccttcaccaacatggaggtgcagctgatccgccagatggagtccgaggggatcttcctgcccagcgagctcgagacccccaacctggcggagcgggtcctggactggctcgagaagcacggcgccgagcgcctgaagcggatggccatctccggggacgactgcgtggtgaagcccatcgacgaccgcttcgccacggccctgaccgcgctcaacgacatgggcaaggtccggaaggacatcccgcagtgggagcccagcaagggctggaacgactggcagcaggtccccttctgctcccaccacttccaccagctgatcatgaaggacgggcgcgagatcgtggtcccctgccggaaccaggacgagctggtgggccgcgcccgggtgagccagggggccggctggtccctccgcgagaccgcctgcctgggcaagagctacgcccagatgtggcagctgatgtacttccaccggcgcgacctccggctggcggccaacgccatctgctccgccgtcccggtggactgggtgcccaccagccgcaccacgtggagcatccacgcgcaccaccagtggatgaccaccgaggacatgctgtccgtctggaaccgggtgtggatcgaggagaacccctggatggaggacaagacccacgtgagctcctgggaggaggtcccctacctcggcaagcgcgaggaccagtggtgcggcagcctgatcgggctgacggcccgcgccacctgggccaccaacatccaggtggccatcaaccaggtgcggcgcctcatcggcaacgagaactacctggactacatgacctccatgaagcggttcaagaacgagagcgacccggagggggcgctgtggtga

SEQ ID NO: 8081 - RNA, 9879 nt, synthetic construct
  misc_feature 1..9879: note = derived and/or modified CDS sequence (opt1) from DENV-1__GQ868513__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacgtgggtgacctacgggacctgcagccagaccggcgagcaccgccgggacaagcgctccgtggccctggcgccccacgtgggcctggggctcgagacgcggaccgagacctggatgagcagcgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcccaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatcccgttctccacccaggacgagaagggggtgacgcagaacggccgcctcatcaccgccaaccccatcgtgaccgacaaggagaagcccgtcaacatcgagaccgagcccccgttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagccccaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggccggacacccccgagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatcccgaagatctacgggggccccatctcccagcacaactaccggcccgggtacttcacccagacggccggcccgtggcacctggggaagctcgagctggacttcgacctgtgcgagggcaccaccgtcgtggtggacgagcactgcggcaaccgcgggcccagcctccggaccacgaccgtcaccggcaagatcatccacgagtggtgctgccgctcctgcaccctgccgcccctgcggttccgcggggaggacggctgctggtacgggatggagatccggccggtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctggtgatggggcagctgacctggaacgacctcatccgcctgtgcatcatggtgggcgcgaacgcctccgaccgcatggggatgggcaccacgtacctggccctcatggccaccttcaagatgcggcccatgttcgccgtcgggctgctgttccgccggctcaccagccgcgaggtgctgctgctcaccatcgggctgtccctggtggcgagcgtcgagctccccaactccctggaggagctgggcgacgggctcgccatgggcatcatgatgctgaagctgctcacggagttccagccccaccagctgtggatcaccctgctcagcctgaccttcatcaagaccacgctgtccctcgactacgcctggaagaccaccgccatggcgctgagcatcgtgtccctgttcccgctctgcctgagcaccacgtcccagaagaccacctggctgcccgtcctcctgggcagcttcgggtgcaagcccctgaccatgttcctcatcaccgagaacaagatctggggccggaagtcctggcccctgaacgaggggatcatggccatcggcatcgtgagcatcctgctctccagcctgctgaagaacgacgtgccgctcgccgggcccctgatcgccggcggcatgctgatcgcctgctacgtcatcagcgggtccagcgcggacctctccctggagaaggccgccgaggtgagctgggagcaggaggccgagcactccggcacgagccacaacatcctggtggaggtccaggacgacgggaccatgaagatcaaggacgaggagcgcgacgacaccctcaccatcctgctgaaggccacgctcctggcggtgtccggcgtgtaccccatgagcatccccgccaccctgttcgtctggtacttctggcagaagaagaagcagcggtccggggtgctctgggacaccccgtccccgcccgaggtggagcgcgccgtcctggacgacggcatctaccggatcctgcagcgcggcctgctcgggcggtcccaggtgggcgtgggggtcttccaggacggcgtgttccacaccatgtggcacgtgacgcgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgcggtggagccggggaagaaccccaagaacgtgcagaccatgcccggcaccttcaagacgcccgagggcgaggtcggggccatcgccctggacttcaagccgggcaccagcgggtcccccatcgtgaaccgggagggcaagatcgtgggcctgtacgggaacggcgtcgtgaccaccagcgggacgtacgtgtccgccatcgcccaggcgaaggccagccaggagggccccctcccggagatcgaggacgaggtcttcaagaagcgcaacctgaccatcatggacctgcaccccgggagcggcaagacccggcgctacctccccgccatggtgcgggaggccatcaagcgcaagctgcggaccctgatcctcgcgcccacgcgcgtggtcgcctccgagatggccgaggccctgaagggcatgccgatccgctaccagaccaccgccgtcaagagcgagcacaccgggcgggagatcgtggacctgatgtgccacgcgacgttcaccatgcgcctcctgtcccccgtccgggtgcccaactacaacatgatcatcatggacgaggcccacttcaccgaccccgccagcatcgccgcccgcggctacatctccacccgggtggggatgggcgaggcggccgccatcttcatgacggccaccccgcccgggagcgtcgaggccttcccccagtccaacgcggtgatccaggacgaggagcgcgacatccccgagcggagctggaactccggctacgactggatcaccgacttcccgggcaagaccgtgtggttcgtccccagcatcaagtccgggaacgacatcgccaactgcctgcgcaagaacggcaagcgggtgatccagctcagccgcaagacgttcgacaccgagtaccagaagaccaagaacaacgactgggactacgtggtcaccacggacatctccgagatgggggccaacttccgggccgaccgcgtgatcgacccccggcgctgcctgaagcccgtgatcctgaaggacggcccggagcgggtcatcctcgcggggcccatgcccgtgaccgtggccagcgccgcccagcgccggggccgcatcggccggaaccagaacaaggagggggaccagtacgtctacatgggccagcccctgaacaacgacgaggaccacgcccactggaccgaggcgaagatgctgctcgacaacatcaacaccccggaggggatcatccccgccctgttcgagcccgagcgcgagaagtccgccgccatcgacggcgagtaccgcctgcgcggggaggcccgcaagacgttcgtggagctcatgcggcgcggcgacctgcccgtctggctgagctacaaggtggcgtccgagggcttccagtacagcgaccggcgctggtgcttcgacggggagcggaacaaccaggtgctcgaggagaacatggacgtcgagatctggaccaaggagggcgagcgcaagaagctgcggccgcgctggctggacgcccggacctactccgaccccctcgccctgcgcgagttcaaggagttcgccgccgggcggcgcagcgtgagcggcgacctgatcctcgagatcggcaagctgccccagcacctgaccctccgggcgcagaacgccctggacaacctggtgatgctccacaactccgagcagggcgggaaggcctaccgccacgccatggaggagctgcccgacaccatcgagacgctgatgctcctggcgctgatcgccgtcctcaccgggggcgtgaccctgttcttcctgagcgggaagggcctcggcaagacctccatcgggctgctgtgcgtgacggccagctccgccctcctgtggatggccagcgtcgagccgcactggatcgcggcctccatcatcctggagttcttcctcatggtgctgctgatccccgagcccgaccggcagcgcaccccgcaggacaaccagctcgcctacgtggtcatcggcctgctgttcatgatcctcaccgtggccgccaacgagatggggctgctggagaccacgaagaaggacctcggcatcgggcacgtggcggccgagaaccaccagcacgccaccatgctggacgtcgacctgcggcccgccagcgcctggaccctctacgcggtggccaccacggtgatcacccccatgatgcgccacaccatcgagaacaccacggccaacatctccctgaccgccatcgccaaccaggcggccatcctgatgggcctcgacaagggctggcccatcagcaagatggacatcggggtcccgctgctggccctcggctgctactcccaggtgaaccccctgaccctgaccgccgcggtgctcatgctggtcgcccactacgccatcatcgggcccggcctgcaggccaaggccacgcgggaggcgcagaagcgcaccgccgccgggatcatgaagaaccccaccgtggacggcatcgtggccatcgacctcgacccggtcgtgtacgacgccaagttcgagaagcagctgggccagatcatgctgctcatcctgtgcaccagccagatcctgctcatgcgcacgacctgggcgctgtgcgagtccatcaccctggccaccgggcccctcacgaccctgtgggagggcagccccgggaagttctggaacaccaccatcgccgtgtccatggccaacatcttccggggcagctacctggccggcgcggggctcgccttctccctgatgaagtccctgggcgggggccgccgggggacgggcgcccagggcgagaccctcggggagaagtggaagcgccagctgaaccagctgtccaagagcgagttcaacacctacaagcggagcggcatcatggaggtcgaccgctccgaggccaaggaggggctcaagcggggcgagaccacgaagcacgcggtgagccgcgggaccgccaagctgcggtggttcgtggagcgcaacctggtcaagcccgagggcaaggtgatcgacctgggctgcgggcggggcgggtggtcctactactgcgccggcctcaagaaggtgaccgaggtcaaggggtacaccaagggcggcccggggcacgaggagcccatccccatggccacctacggctggaacctggtgaagctgcacagcgggaaggacgtgttcttcatgcccccggagaagtgcgacacgctcctgtgcgacatcggcgagtccagccccaaccccaccatcgaggaggggcgcaccctgcgggtcctcaagatggtggagccctggctgcgcggcaaccagttctgcatcaagatcctgaacccgtacatgccctccgtggtcgagaccctcgagcagatgcagcggaagcacggcgggatgctggtgcgcaaccccctgagccggaactccacgcacgagatgtactgggtgagctgcggcaccgggaacatcgtctccgccgtgaacatgaccagccgcatgctcctgaaccggttcaccatggcgcaccgcaagcccacgtacgagcgcgacgtggacctgggcgccggcacccggcacgtcgccgtggagccggaggtggccaacctcgacatcatcgggcagcgcatcgagaacatcaagaacgagcacaagtccacctggcactacgacgaggacaacccctacaagacctgggcctaccacggcagctacgaggtcaagccctccgggagcgcgtccagcatggtgaacggcgtggtccggctgctgacgaagccctgggacgtgatcccgatggtcacccagatcgccatgaccgacaccacgcccttcgggcagcagcgcgtgttcaaggagaaggtggacacccggacgccccgggccaagcggggcaccacgcagatcatggaggtcaccgccaagtggctctggggcttcctgtcccgcaacaagaagccgcggatctgcacccgcgaggagttcacccggaaggtgcgcagcaacgccgcgatcggggccgtgttcgtcgacgagaaccagtggaacagcgccaaggaggccgtggaggacgagcggttctgggacctggtgcaccgcgagcgggagctccacaagcagggcaagtgcgcgacgtgcgtctacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatccccggcggcaacatgtacgcggacgacaccgccgggtgggacacccggatcaccgaggacgacctccagaacgaggccaagatcacggagatcatggagcccgagcacgccctgctggccaccagcatcttcaagctcacctaccagaacaaggtggtccgcgtgcagcgccccgcgaagaacggcaccgtgatggacgtcatctcccggcgcgaccagcgggggagcggccaggtgggcacgtacgggctgaacaccttcaccaacatggaggtgcagctgatccgccagatggagtccgagggcatcttcctcccgagcgagctggagacccccaacctggccgagcgggtcctcgactggctggagaagcacggggccgagcgcctgaagcggatggccatctccggcgacgactgcgtggtgaagcccatcgacgaccgcttcgccacggcgctcaccgccctgaacgacatggggaaggtccggaaggacatcccccagtgggagccgagcaagggctggaacgactggcagcaggtccccttctgctcccaccacttccaccagctgatcatgaaggacggccgcgagatcgtggtcccctgccggaaccaggacgagctcgtggggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgctccgcggtccccgtggactgggtgccgaccagccgcaccacgtggagcatccacgcccaccaccagtggatgaccaccgaggacatgctctccgtctggaaccgggtgtggatcgaggagaacccctggatggaggacaagacccacgtgagctcctgggaggaggtcccctacctggggaagcgcgaggaccagtggtgcggcagcctgatcggcctcacggcccgcgccacctgggccaccaacatccaggtggcgatcaaccaggtgcggcgcctgatcgggaacgagaactacctggactacatgacctccatgaagcggttcaagaacgagagcgaccccgagggcgccctctggtga

SEQ ID NO: 8082 - RNA, 9879 nt, synthetic construct
  misc_feature 1..9879: note = derived and/or modified CDS sequence (opt1) from DENV-1__GU131973__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcgcgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgtgagcatcatgatcgaggaggtcatgcggtcccgctggagccggaagatgctcatgacgggcaccctggccgtgttcctgctcctggtgatggggcagctgacctggaacgacctcatccgcctgtgcatcatggtcggcgccaacgcgtccgaccgcatggggatgggcaccacgtacctggccctcatggccaccttcaagatgcggccgatgttcgccgtggggctgctgttccgccggctcaccagccgcgaggtgctgctgctcaccatcgggctgtccctggtcgccagcgtggagctccccaactccctggaggagctgggcgacgggctcgcgatgggcatcatgatgctgaagctgctcacggagttccagccccaccagctgtggaccaccctgctcagcctgaccttcatcaagacgaccctgtccctcgactacgcctggaagaccaccgccatggccctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggccgtgtccggcgtctaccccatgagcatccccgcgaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcaccagcgggtccccgatcgtgaaccgggagggcaagatcgtcggcctgtacgggaacggcgtggtgacgaccagcgggacctacgtctccgccatcgcccaggccaaggcgagccaggagggccccctccccgagatcgaggacgaggtgttcaagaagcgcaacctgaccatcatggacctgcacccggggagcggcaagacgcggcgctacctccccgccatcgtgcgggaggccatcaagcgcaagatgcggaccctgatcctggcccccacccgcgtcgtggcgtccgagatggccgaggccctcaagggcatgcccatccgctaccagaccacggccgtcaagagcgagcacaccgggcgggagatcgtcgacctgatgtgccacgccaccttcaccatgcgcctgctctccccggtgcgggtgcccaactacaacatgatcatcatggacgaggcgcacttcacggaccccgccagcatcgccgcccgcggctacatctccacccgggtcgggatgggcgaggccgcggccatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgcgaactgcctgcgcaagaacggcaagcgggtgatccagctgagccgcaagaccttcgacaccgagtaccagaagacgaagaacaacgactgggactacgtcgtgaccaccgacatctccgagatgggggccaacttccgggccgaccgcgtgatcgacccccggcgctgcctcaagcccgtcatcctgaaggacggccccgagcgggtgatcctggccgggccgatgcccgtgaccgtcgcgagcgccgcccagcgccggggccgcatcggccggaaccagaacaaggagggggaccagtacgtgtacatgggccagcccctcaacaacgacgaggaccacgcccactggacggaggccaagatgctgctggacaacatcaacacccccgaggggatcatcccggccctcttcgagcccgagcgcgagaagtccgccgccatcgacggcgagtaccgcctgcgcggggaggcccgcaagaccttcgtcgagctgatgcggcgcggcgacctccccgtgtggctgagctacaaggtggcctccgagggcttccagtacagcgaccggcgctggtgcttcgacggggagcggaacaaccaggtcctggaggagaacatggacgtggagatctggaccaaggagggcgagcgcaagaagctccggccccgctggctggacgcgcggacctactccgacccgctggccctccgcgagttcaaggagttcgccgccgggcggcgcagcgtgagcggcgacctgatcctggagatcggcaagctcccccagcacctgacgctgcgggcccagaacgcgctcgacaacctggtcatgctgcacaactccgagcagggcgggaaggcctaccgccacgccatggaggagctccccgacaccatcgagaccctgatgctgctcgccctgatcgcggtgctgaccgggggcgtgaccctcttcttcctgagcgggaagggcctgggcaagacctccatcgggctcctgtgcgtcaccgccagctccgccctgctctggatggccagcgtggagccccactggatcgccgcgtccatcatcctggagttcttcctgatggtgctcctgatcccggagcccgaccggcagcgcacgccccaggacaaccagctggcctacgtcgtgatcggcctcctgttcatgatcctgacggtggccgccaacgagatggggctcctggagaccaccaagaaggacctgggcatcgggcacgtcgccgcggagaaccaccagcacgccaccatgctcgacgtggacctgcggccggccagcgcctggacgctgtacgccgtggcgaccaccgtcatcacccccatgatgcgccacacgatcgagaacaccaccgccaacatctccctcaccgccatcgccaaccaggccgcgatcctgatgggcctggacaagggctggcccatcagcaagatggacatcggggtgcccctcctggccctgggctgctactcccaggtgaacccgctcacgctgaccgccgccgtcctgatgctcgtggcgcactacgccatcatcgggcccggcctgcaggccaaggccacccgggaggcccagaagcgcaccgcggccgggatcatgaagaaccccacggtggacggcatcgtcgccatcgacctggaccccgtggtgtacgacgccaagttcgagaagcagctcggccagatcatgctgctgatcctctgcaccagccagatcctgctgatgcgcaccacctgggccctctgcgagtccatcacgctggcgaccgggccgctgaccaccctctgggagggcagccccgggaagttctggaacacgaccatcgccgtctccatggccaacatcttccggggcagctacctggccggcgccgggctggcgttctccctcatgaagtccctgggcgggggccgccgggggaccggcgcccagggcgagaccctgggggagaagtggaagcgccagctcaaccagctgtccaagagcgagttcaacacgtacaagcggagcggcatcatggaggtggaccgctccgaggccaaggaggggctgaagcggggcgagaccaccaagcacgccgtgagccgcgggaccgcgaagctccggtggttcgtcgagcgcaacctggtgaagcccgagggcaaggtgatcgacctgggctgcgggcggggcgggtggtcctactactgcgccggcctgaagaaggtcaccgaggtgaaggggtacacgaagggcggccccgggcacgaggagccgatccccatggccacctacggctggaacctcgtgaagctgcacagcgggaaggacgtcttcttcatgccgcccgagaagtgcgacaccctgctctgcgacatcggcgagtccagcccgaaccccaccatcgaggaggggcgcacgctgcgggtgctgaagatggtggagccctggctccgcggcaaccagttctgcatcaagatcctgaacccctacatgccgtccgtcgtggaggccctggagcagatgcagcggaagcacggcgggatgctcgtgcgcaaccccctgagccggaactccacccacgagatgtactgggtcagctgcggcaccgggaacatcgtgtccgccgtgaacatgaccagccgcatgctgctcaaccggttcacgatggcgcaccgcaagcccacctacgagcgcgacgtcgacctgggcgccggcacccggcacgtggccgtggagcccgaggtcgccaacctggacatcatcgggcagcgcatcgagaacatcaagaacgagcacaagtccacctggcactacgacgaggacaacccgtacaagacgtgggcctaccacggcagctacgaggtgaagccctccgggagcgcgtccagcatggtgaacggcgtcgtgcggctcctgaccaagccctgggacgtcatccccatggtgacccagatcgccatgaccgacacgaccccgttcgggcagcagcgcgtgttcaaggagaaggtcgacacccggacgccccgggccaagcggggcacgacccagatcatggaggtgaccgccaagtggctgtggggcttcctctcccgcaacaagaagccccggatctgcacccgcgaggagttcacgcggaaggtgcgcagcaacgccgcgatcggggccgtcttcgtggacgagaaccagtggaacagcgccaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggctcccgggccatctggtacatgtggctgggcgcccgcttcctggagttcgaggccctcgggttcatgaacgaggaccactggttcagccgggagaactccctgagcggcgtggagggggagggcctgcacaagctcgggtacatcctgcgcgacatctccaagatcccgggcggcaacatgtacgcggacgacaccgccgggtgggacacccggatcacggaggacgacctgcagaacgaggccaagatcaccgagatcatggagcccgagcacgccctcctggccaccagcatcttcaagctgacctaccagaacaaggtcgtgcgcgtgcagcgccccgcgaagaacggcacggtcatggacgtgatctcccggcgcgaccagcgggggagcggccaggtgggcacctacgggctcaacaccttcaccaacatggaggtccagctgatccgccagatggagtccgagggcatcttcctgcccagcgagctcgagacgccgaacctggccgagcgggtgctggactggctcgagaagcacggggccgagcgcctgaagcggatggccatctccggcgacgactgcgtggtcaagcccatcgacgaccgcttcgccaccgcgctgaccgccctcaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctggtggggcgcgcccgggtcagccagggcgccgggtggtccctccgcgagaccgcctgcctgggcaagagctacgcgcagatgtggcagctgatgtacttccaccggcgcgacctccggctggccgccaacgccatctgctccgcggtgcccgtggactgggtccccaccagccgcacgacctggagcatccacgcccaccaccagtggatgaccaccgaggacatgctgtccgtgtggaaccgggtgtggatcgaggagaacccgtggatggaggacaagacgcacgtcagctcctgggaggaggtgccctacctcgggaagcgcgaggaccagtggtgcggcagcctgatcggcctgaccgcccgcgccacctgggccaccaacatccaggtggcgatcaaccaggtccggcgcctcatcgggaacgagaactacctggactacatgacgtccatgaagcggttcaagaacgagagcgaccccgagggcgccctgtggtga

SEQ ID NO: 8083 - RNA, 9879 nt, synthetic construct
  misc_feature 1..9879: note = derived and/or modified CDS sequence (opt1) from DENV-1__GQ868517__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctgttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttcctcacccaggacgagaagggggtgacgcagaacggccgcctgatcaccgccaacccgatcgtgaccgacaaggagaagcccgtcaacatcgagaccgagccgcccttcggggagtcctacatcgtggtgggcgccggcgagaaggcgctgaagctcagctggttcaagaaggggtccagcatcggcaagatgttcgaggccacggcccgcggggcccgccggatggccatcctgggcgacaccgcgtgggacttcgggtccatcggcggcgtcttcaccagcgtggggaagctggtgcaccaggtcttcggcaccgcctacggggtcctgttctccggcgtgagctggacgatgaagatcgggatcggcatcctgctgacctggctcggcctgaactcccgcagcacctccctgagcatgacctgcatcgccgtcgggatggtgacgctctacctgggcgtgatggtccaggccgactccgggtgcgtgatcaactggaagggccgcgagctgaagtgcgggagcggcatcttcgtgaccaacgaggtccacacctggaccgagcagtacaagttccaggccgactccccgaagcggctcagcgcggccatcggcaaggcctgggaggagggggtgtgcggcatccgcagcgccacccggctggagaacatcatgtggaagcagatctccaacgagctgaaccacatcctcctggagaacgacatgaagttcacggtggtcgtgggggacgccaacggcatcctggcgcaggggaagaagatgatccgcccccagcccatggagcacaagtacagctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctcaagctgcgcgacagctacacccagatgtgcgaccaccggctgatgtccgcggccatcaaggacagcaaggccgtccacgccgacatgggctactggatcgagtccgagaagaacgagacctggaagctcgcccgcgcgagcttcatcgaggtgaagacgtgcacctggcccaagtcccacaccctgtggagcaacggcgtgctggagtccgagatgatcatccccaagatctacgggggcccgatcagccagcacaactaccggcccgggtacttcacccagacggccggcccctggcacctcgggaagctggagctggacttcgacctctgcgagggcaccaccgtcgtggtggacgagcactgcggcaaccgcgggccgtccctgcggaccacgaccgtcaccggcaagatcatccacgagtggtgctgccgcagctgcaccctgccgcccctccggttccgcggggaggacggctgctggtacgggatggagatccggcccgtgaaggagaaggaggagaacctggtgcgctccatggtcagcgccggctccggcgaggtggacagcttcagcctggggatcctctgcgcctccatcatgatcgaggaggtgatgcggagccgctggtcccggaagatgctgatgacgggcaccctggccgtcttcctcctgctgatcatggggcagctcacctggaacgacctgatccgcctgtgcatcatggtgggcgcgaacgccagcgaccgcatggggatgggcaccacgtacctcgccctgatggccaccttcaagatgcggccgatgttcgccgtggggctcctcttccgccggctgacctcccgcgaggtcctgctcctgaccatcgggctgagcctcgtggcgtccgtggagctgcccaacagcctggaggagctcggcgacgggctggccatgggcatcatgatgctgaagctcctgacggagttccagccccaccagctgtggaccaccctcctgtccctgaccttcatcaagacgaccctcagcctggactacgcctggaagaccaccgccatggtcctgtccatcgtgagcctcttccccctgtgcctgtccacgaccagccagaagaccacctggctcccggtcctgctgggctccttcgggtgcaagcccctcaccatgttcctgatcacggagaacaagatctggggccgcaagagctggcccctgaacgaggggatcatggcgatcggcatcgtgtccatcctcctgagctccctgctcaagaacgacgtgcccctggccgggccgctgatcgccggcggcatgctcatcgcctgctacgtcatcagcgggagctccgccgacctgagcctggagaaggcggccgaggtgtcctgggagcaggaggccgagcacagcggcacctcccacaacatcctcgtggaggtccaggacgacgggaccatgaagatcaaggacgaggagcgcgacgacaccctgacgatcctgctcaaggccaccctgctggccgtgagcggcgtgtaccccatgtccatccccgcgaccctcttcgtctggtacttctggcagaagaagaagcagcggagcggggtgctgtgggacaccccctccccgcccgaggtggagcgcgccgtcctggacgacggcatctaccggatcctgcagcgcggcctcctggggcggagccaggtgggcgtgggggtcttccaggacggcgtgttccacacgatgtggcacgtgacccgcggggccgtcctgatgtaccagggcaagcggctcgagccctcctgggccagcgtgaagaaggacctgatctcctacggcgggggctggcgcttccaggggagctggaacaccggcgaggaggtgcaggtcatcgccgtggagcccgggaagaacccgaagaacgtgcagaccacgcccggcaccttcaagacccccgagggcgaggtcggggcgatcgccctggacttcaagcccggcacctccgggagcccgatcgtgaaccgggagggcaagatcgtgggcctctacgggaacggcgtcgtgacgacctccgggacctacgtgagcgccatcgcccaggccaaggcgtcccaggagggccccctgcccgagatcgaggacgaggtcttcaagaagcgcaacctgaccatcatggacctccacccggggagcggcaagacgcggcgctacctgcccgccatcgtgcgggaggccatcaagcgcaagctgcggaccctcatcctggcccccacccgcgtggtcgcgagcgagatggccgaggccctgaagggcatgcccatccgctaccagaccacggccgtgaagtccgagcacaccgggcgggagatcgtggacctcatgtgccacgccaccttcaccatgcgcctgctgagcccggtccgggtgcccaactacaacatgatcatcatggacgaggcgcacttcacggaccccgcctccatcgccgcccgcggctacatcagcacccgggtggggatgggcgaggccgcggccatcttcatgaccgccacgccgcccgggtccgtcgaggccttcccccagagcaacgccgtgatccaggacgaggagcgcgacatccccgagcggtcctggaacagcggctacgactggatcacggacttccccggcaagaccgtgtggttcgtcccctccatcaagagcgggaacgacatcgcgaactgcctccgcaagaacggcaagcgggtgatccagctgtcccgcaagaccttcgacaccgagtaccagaagacgaagaacaacgactgggactacgtggtcaccaccgacatcagcgagatgggggccaacttccgggccgaccgcgtgatcgacccccggcgctgcctgaagcccgtgatcctcaaggacggccccgagcgggtcatcctggccgggccgatgcccgtgaccgtggcgtccgccgcccagcgccggggccgcatcggccggaaccagaacaaggagggggaccagtacgtctacatgggccagcccctgaacaacgacgaggaccacgcccactggacggaggccaagatgctcctggacaacatcaacacccccgaggggatcatcccggcgctgttcgagcccgagcgcgagaagtccgccgccatcgacggcgagtaccgcctccgcggggaggcccgcaagaccttcgtggagctgatgcggcgcggcgacctgcccgtctggctctcctacaaggtggccagcgagggcttccagtactccgaccggcgctggtgcttcgacggggagcggaacaaccaggtgctggaggagaacatggacgtcgagatctggaccaaggagggcgagcgcaagaagctgcggccccgctggctcgacgcgcggacctacagcgacccgctggccctgcgcgagttcaaggagttcgccgccgggcggcgctccgtgagcggcgacctcatcctggagatcggcaagctgccccagcacctcacgctgcgggcccagaacgcgctggacaacctcgtgatgctgcacaacagcgagcagggcgggaaggcctaccgccacgccatggaggagctgcccgacaccatcgagaccctcatgctgctggccctcatcgcggtcctgaccgggggcgtgacgctgttcttcctctccgggaagggcctgggcaagaccagcatcgggctgctctgcgtgaccgcctccagcgccctgctgtggatggcctccgtcgagccccactggatcgccgcgagcatcatcctcgagttcttcctgatggtgctgctcatcccggagcccgaccggcagcgcacgccccaggacaaccagctggcctacgtggtcatcggcctcctcttcatgatcctgacggtggccgccaacgagatggggctgctcgagaccaccaagaaggacctgggcatcgggcacgtggccgcggagaaccaccagcacgccaccatgctggacgtcgacctccggccggcctccgcctggacgctgtacgccgtggcgaccaccgtgatcacccccatgatgcgccacacgatcgagaacaccaccgccaacatcagcctgaccgccatcgccaaccaggccgcgatcctcatgggcctggacaagggctggcccatctccaagatggacatcggggtccccctgctcgccctgggctgctacagccaggtgaacccgctgacgctcaccgccgccgtgctgatgctggtcgcgcactacgccatcatcgggcccggcctccaggccaaggccacccgggaggcccagaagcgcaccgcggccgggatcatgaagaaccccacggtggacggcatcgtggccatcgacctggaccccgtcgtgtacgacgccaagttcgagaagcagctgggccagatcatgctcctgatcctgtgcacctcccagatcctcctgatgcgcaccacctgggccctgtgcgagagcatcacgctcgcgaccgggccgctgaccaccctgtgggagggctcccccgggaagttctggaacacgaccatcgccgtgagcatggccaacatcttccggggctcctacctcgccggcgccgggctggcgttcagcctgatgaagtccctcggcgggggccgccgggggaccggcgcccagggcgagaccctgggggagaagtggaagcgccagctgaaccagctcagcaagtccgagttcaacacgtacaagcggagcggcatcatggaggtcgaccgcagcgaggccaaggaggggctgaagcggggcgagaccaccaagcacgccgtgtcccgcgggaccgcgaagctgcggtggttcgtggagcgcaacctggtcaagcccgagggcaaggtgatcgacctcggctgcgggcggggcgggtggagctactactgcgccggcctgaagaaggtgaccgaggtcaaggggtacacgaagggcggccccgggcacgaggagccgatccccatggccacctacggctggaacctggtgaagctccactccgggaaggacgtgttcttcatgccgcccgagaagtgcgacaccctgctgtgcgacatcggcgagagctccccgaaccccaccatcgaggaggggcgcacgctccgggtcctgaagatggtggagccctggctgcgcggcaaccagttctgcatcaagatcctcaacccctacatgccgagcgtggtcgagaccctggagcagatgcagcggaagcacggcgggatgctggtgcgcaaccccctctcccggaacagcacccacgagatgtactgggtgtcctgcggcaccgggaacatcgtcagcgccgtgaacatgacgtcccgcatgctgctgaaccggttcaccatggcccaccgcaagcccaccttcgagcgcgacgtggacctcggcgcgggcacccggcacgtcgccgtggagcccgaggtggccaacctggacatcatcgggcagcgcatcgagaacatcaagaacgagcacaagagcacgtggcactacgacgaggacaacccgtacaagacctgggcctaccacggctcctacgaggtcaagcccagcgggtccgccagctccatggtgaacggcgtggtccggctgctcaccaagccctgggacgtgatccccatggtcacccagatcgcgatgacggacaccaccccgttcgggcagcagcgcgtgttcaaggagaaggtggacacccggacgccccgcgccaagcggggcaccacccagatcatggaggtcaccgccaagtggctgtggggcttcctgagccgcaacaagaagccccggatctgcacgcgcgaggagttcacccggaaggtgcgctccaacgccgccatcggggcggtgttcgtcgacgagaaccagtggaacagcgccaaggaggccgtggaggacgagcggttctgggacctcgtgcaccgcgagcgggagctgcacaagcagggcaagtgcgcgacctgcgtctacaacatgatggggaagcgcgagaagaagctgggcgagttcgggaaggcgaagggcagccgggccatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatcccgggcggcaacatgtacgccgacgacaccgcggggtgggacacgcggatcaccgaggacgacctgcagaacgaggccaagatcaccgacatcatggagcccgagcacgccctgctcgccacctccatcttcaagctgacgtaccagaacaaggtggtccgcgtgcagcgccccgccaagaacggcaccgtgatggacgtcatcagccggcgcgaccagcgggggtccggccaggtgggcacctacgggctgaacaccttcacgaacatggaggtgcagctcatccgccagatggagagcgagggcatcttcctgccctccgagctggagaccccgaacctcgcggagcgggtcctggactggctggagaagcacggggccgagcgcctcaagcggatggccatcagcggcgacgactgcgtggtgaagcccatcgacgaccgcttcgccaccgccctgaccgcgctgaacgacatggggaaggtccggaaggacatcccccagtgggagccctccaagggctggaacgactggcagcaggtcccgttctgcagccaccacttccaccagctcatcatgaaggacggccgcgagatcgtggtcccctgccggaaccaggacgagctggtggggcgcgcccgggtgtcccagggcgccgggtggagcctgcgcgagaccgcctgcctcggcaagtcctacgcccagatgtggcagctgatgtacttccaccggcgcgacctgcggctcgcggccaacgccatctgcagcgccgtccccgtggactgggtgcccacgtcccgcaccacctggagcatccacgcgcaccaccagtggatgaccacggaggacatgctgagcgtctggaaccgggtgtggatcgaggagaacccgtggatggaggacaagacccacgtgtccagctgggaggaggtcccctacctggggaagcgcgaggaccagtggtgcggctccctcatcggcctgaccgcccgcgccacctgggccacgaacatccaggtggccatcaaccaggtgcggcgcctgatcgggaacgagaactacctcgactacatgaccagcatgaagcggttcaagaacgagtccgaccccgagggcgcgctgtggtga

SEQ ID NO: 8084 - RNA, 9879 nt, synthetic construct
  misc_feature 1..9879: note = derived and/or modified CDS sequence (opt1) from DENV-1__GU131976__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctgttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcctcatgatcgaggaggtgatgcggtcccgctggagccggaagatgctgatgacgggcaccctggccgtcttcctcctgctgatcatggggcagctcacctggaacgacctgatccgcctgtgcatcatggtgggcgcgaacgcctccgaccgcatggggatgggcaccacgtacctcgccctgatggccaccttcaagatgcggccgatgttcgccgtggggctcctgttccgccggctgaccagccgcgaggtcctgctcctgaccatcgggctgtccctcgtggcgagcgtggagctgcccaactccctggaggagctcggcgacgggctggccatgggcatcatgatgctgaagctcctgacggagttccagccccaccagctgtggaccaccctcctgagcctgaccttcatcaagacgaccctctccctggactacgcctggaagaccaccgccatggcgctgagcatcgtctccctcttccccctgtgcctgagcacgacctcccagaagaccacctggctcccggtgctgctgggcagcttcgggtgcaagcccctcaccatgttcctgatcacggagaacaagatctggggccggaagtcctggcccctgaacgaggggatcatggccatcggcatcgtcagcatcctcctgtccagcctgctcaagaacgacgtgcccctggccgggccgctgatcgccggcggcatgctcatcgcctgctacgtgatcagcgggtccagcgcggacctgtccctggagaaggccgccgaggtcagctgggagcaggaggccgagcactccggcaccagccacaacatcctcgtggaggtgcaggacgacgggaccatgaagatcaaggacgaggagcgcgacgacaccctgacgatcctgctcaaggccaccctgctggcggtctccggcgtgtaccccatgagcatccccgccaccctcttcgtgtggtacttctggcagaagaagaagcagcggtccggggtcctgtgggacacccccagcccgcccgaggtggagcgcgccgtgctggacgacggcatctaccggatcctgcagcgcggcctcctggggcggtcccaggtcggcgtgggggtgttccaggacggcgtcttccacacgatgtggcacgtgacccgcggggccgtgctgatgtaccagggcaagcggctcgagcccagctgggcctccgtcaagaaggacctgatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctctacgggaacggcgtggtcacgaccagcgggacctacgtgtccgccatcgcccaggcgaaggccagccaggagggccccctgcccgagatcgaggacgaggtgttcaagaagcgcaacctgaccatcatggacctccacccggggagcggcaagacgcggcgctacctgcccgccatcgtccgggaggccatcaagcgcaagctgcggaccctcatcctggcgcccacccgcgtggtggcctccgagatggccgaggccctgaagggcatgcccatccgctaccagaccacggccgtcaagagcgagcacaccgggcgggagatcgtggacctcatgtgccacgcgaccttcaccatgcgcctgctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctccgcaagaacggcaagcgggtcatccagctgagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctcaaggacggccccgagcgggtgatcctggcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctcctggacaacatcaacacccccgaggggatcatcccggccctgttcgagcccgagcgcgagaagtccgccgccatcgacggcgagtaccgcctccgcggggaggcccgcaagaccttcgtcgagctgatgcggcgcggcgacctgcccgtgtggctcagctacaaggtcgcgtccgagggcttccagtacagcgaccggcgctggtgcttcgacggggagcggaacaaccaggtgctggaggagaacatggacgtggagatctggaccaaggagggcgagcgcaagaagctgcggccccgctggctcgacgcccggacctactccgacccgctggccctgcgcgagttcaaggagttcgccgccgggcggcgcagcgtcagcggcgacctcatcctggagatcggcaagctgccccagcacctcacgctgaaggcgcagaacgccctggacaacctcgtgatgctgcacaactccgagcagggcgggaaggcctaccggcacgccatggaggagctgcccgacaccatcgagaccctcatgctgctggcgctcatcgccgtgctgaccgggggcgtcacgctgttcttcctcagcgggaagggcctgggcaagacctccatcgggctgctctgcgtgaccgccagctccgccctgctgtggatggccagcgtggagccccactggatcgcggcctccatcatcctcgagttcttcctgatggtcctgctcatcccggagcccgaccgccagcggacgccccaggacaaccagctggcctacgtggtgatcggcctcctcttcatgatcctgacggtcgccgccaacgagatggggctgctcgagaccaccaagaaggacctgggcatcgggcacgtggcggccgagaaccaccagcacgccaccatgctggacgtggacctccgcccggccagcgcctggacgctgtacgcggtcgccaccaccgtgatcacccccatgatgcggcacacgatcgagaacaccaccgccaacatctccctgaccgccatcgccaaccaggcggccatcctcatgggcctggacaagggctggcccatcagcaagatggacatcggggtgcccctgctcgccctgggctgctactcccaggtcaacccgctgacgctcaccgccgcggtgctgatgctggtggcccactacgccatcatcgggcccggcctccaggccaaggccacccgcgaggcgcagaagcggaccgccgccgggatcatgaagaaccccacggtcgacggcatcgtggccatcgacctggaccccgtggtctacgacgccaagttcgagaagcagctgggccagatcatgctcctgatcctgtgcaccagccagatcctcctgatgcgcaccacctgggcgctgtgcgagtccatcacgctcgccaccgggccgctgaccaccctgtgggagggcagccccgggaagttctggaacacgaccatcgccgtgtccatggccaacatcttccgcggcagctacctcgccggcgcggggctggccttctccctgatgaagtccctcggcgggggccggcgcgggaccggcgcccagggcgagaccctgggggagaagtggaagcggcagctgaaccagctctccaagagcgagttcaacacgtacaagcgcagcggcatcatggaggtggaccggtccgaggccaaggaggggctgaagcgcggcgagaccaccaagcacgcggtcagccgggggaccgccaagctgcgctggttcgtggagcggaacctggtgaagcccgagggcaaggtcatcgacctcggctgcgggcgcggcgggtggtcctactactgcgccggcctgaagaaggtgaccgaggtgaaggggtacacgaagggcggccccgggcacgaggagccgatccccatggccacctacggctggaacctggtcaagctccacagcgggaaggacgtgttcttcatgccgcccgagaagtgcgacaccctgctgtgcgacatcggcgagtccagcccgaaccccaccatcgaggaggggcggacgctccgcgtgctgaagatggtcgagccctggctgcggggcaaccagttctgcatcaagatcctcaacccctacatgccgtccgtggtggagaccctggagcagatgcagcgcaagcacggcgggatgctggtccggaaccccctcagccgcaactccacccacgagatgtactgggtgagctgcggcaccgggaacatcgtgtccgccgtcaacatgacgagccggatgctgctgaaccgcttcaccatggcgcaccggaagcccaccttcgagcgcgacgtggacctcggcgccggcacccgccacgtggccgtcgagcccgaggtggccaacctggacatcatcgggcagcggatcgagaacatcaagaacgagcacaagtccacgtggcactacgacgaggacaacccgtacaagacctgggcctaccacggcagctacgaggtgaagccctccgggagcgcgtccagcatggtcaacggcgtggtgcgcctgctcaccaagccctgggacgtcatccccatggtgacccagatcgccatgacggacaccaccccgttcgggcagcagcgggtcttcaaggagaaggtggacacccgcacgccccgggccaagcgcggcaccacccagatcatggaggtgaccgccaagtggctgtggggcttcctgtcccggaacaagaagccccgcatctgcacgcgggaggagttcacccgcaaggtccggagcaacgccgcgatcggggccgtgttcgtggacgagaaccagtggaacagcgccaaggaggccgtcgaggacgagcgcttctgggacctcgtgcaccgggagcgcgagctgcacaagcagggcaagtgcgcgacctgcgtgtacaacatgatggggaagcgggagaagaagctgggcgagttcgggaaggccaagggctcccgcgccatctggtacatgtggctcggcgcccggttcctggagttcgaggccctggggttcatgaacgaggaccactggttcagccgcgagaactccctcagcggcgtcgagggggagggcctgcacaagctggggtacatcctccgggacatctccaagatcccgggcggcaacatgtacgcggacgacaccgccgggtgggacacgcgcatcaccgaggacgacctgcagaacgaggccaagatcaccgacatcatggagcccgagcacgccctgctcgccaccagcatcttcaagctgacgtaccagaacaaggtggtgcgggtccagcgccccgcgaagaacggcaccgtgatggacgtgatctcccgccgggaccagcgcgggagcggccaggtcggcacctacgggctgaacaccttcacgaacatggaggtgcagctcatccggcagatggagtccgagggcatcttcctgcccagcgagctggagaccccgaacctcgccgagcgcgtgctggactggctggagaagcacgggaccgagcggctcaagcgcatggccatctccggcgacgactgcgtcgtgaagcccatcgacgaccggttcgccaccgccctgaccgcgctgaacgacatggggaaggtgcgcaaggacatcccccagtgggagcccagcaagggctggaacgactggcagcaggtcccgttctgctcccaccacttccaccagctcatcatgaaggacggccgggagatcgtggtgccctgccgcaaccaggacgagctggtcgggcgggcccgcgtgagccagggcgccgggtggtccctgcgggagacggcctgcctcggcaagagctacgcccagatgtggcagctgatgtacttccaccgccgggacctgcgcctcgcggccaacgccatctgctccgccgtgcccgtcgactgggtgcccaccagccggaccacctggagcatccacgcgcaccaccagtggatgacgaccgaggacatgctgtccgtgtggaaccgcgtctggatcgaggagaacccgtggatggaggacaagacccacgtgagctcctgggaggaggtgccctacctggggaagcgggaggaccagtggtgcggcagcctcatcggcctgaccgcccgcgccacgtgggccaccaacatccaggtcgccatcaaccaggtgcgccggctgatcgggaacgagaactacctcgactacatgacctccatgaagcgcttcaagaacgagagcgaccccgagggcgcgctgtggtga

SEQ ID NO: 8085 - RNA, 9879 nt, synthetic construct
  misc_feature 1..9879: note = derived and/or modified CDS sequence (opt1) from DENV-1__GQ868518__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacgtgggtgacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctggtgatggggcagctgacctggaacgacctcatccgcctgtgcatcatggtgggcgcgaacgcctccgaccgcatggggatgggcaccacgtacctggccctcatggccaccttcaagatgcggccgatgttcgccgtcgggctgctgttccgccggctcaccagccgcgaggtgctgctgctcaccatcgggctgtccctggtggcgagcgtcgagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtgtccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggtccagcgcggacctctccctggagaaggccgccgaggtgagctgggagcaggaggccgagcactccggccccagccacaacatcctggtggaggtccaggacgacgggaccatgaagatcaaggacgaggagcgcgacgacaccctcaccatcctgctgaaggccacgctcctggcggtgtccggcgtgtaccccatgagcatccccgccaccctgttcgtctggtacttctggcagaagaagaagcagcggtccggggtgctctgggacaccccgtccccgcccgaggtggagcgcgccgtcctggacgacggcatctaccggatcctgcagcgcggcctgctcgggcggtcccaggtgggcgtgggggtcttccaggacggcgtgttccacaccatgtggcacgtgacgcgcggggccgtcctgatgtaccagggcaagcggctggagcccagctgggcctccgtgaagaaggacctcatcagctacggcgggggctggcgcttccgggggtcctggaacaccggcgaggaggtgcaggtcatcgcggtggagccggggaagaaccccaagaacgtgcagaccacccccggcacgttcaagacccccgagggcgaggtcggggccatcgccctggacttcaagccgggcaccagcgggtcccccatcgtgaaccgcgagggcaagatcgtgggcctgtacgggaacggcgtcgtgaccacgagcgggacctacgtgtccgccatcgcccaggcgaaggccagccaggagggccccctcccggagatcgaggacgaggtcttcaagaagcggaacctgaccatcatggacctgcaccccgggagcggcaagacccgccggtacctccccgccatcgtgcgcgaggccatcaagcggaagctgcgcacgctgatcctcgcgcccacccgcgtggtcgcctccgagatggccgaggccctgaagggcatgccgatccggtaccagaccaccgccgtcaagagcgagcacacggggcgcgagatcgtggacctgatgtgccacgcgaccttcaccatgcggctcctgtcccccgtccgcgtgcccaactacaacatgatcatcatggacgaggcccacttcaccgaccccgccagcatcgccgcccggggctacatctccacgcgcgtggggatgggcgaggcggccgccatcttcatgaccgccaccccgcccgggagcgtcgaggccttcccccagtccaacgcggtgatccaggacgaggagcgggacatccccgagcgcagctggaactccggctacgactggatcaccgacttcccgggcaagacggtgtggttcgtccccagcatcaagtccgggaacgacatcgccaactgcctgcggaagaacggcaagcgcgtgatccagctcagccggaagaccttcgacaccgagtaccagaagaccaagaacaacgactgggactacgtggtcacgaccgacatctccgagatgggggccaacttccgcgccgaccgggtgatcgacccccgccggtgcctgaagcccgtgatcctgaaggacggcccggagcgcgtcatcctcgcggggcccatgcccgtgaccgtggccagcgccgcccagcggcgcggccggatcggccgcaaccagaacaaggagggggaccagtacgtctacatgggccagcccctgaacaacgacgaggaccacgcccactggaccgaggcgaagatgctgctcgacaacatcaacacgccggaggggatcatccccgccctgttcgagcccgagcgcgagaagtccgccgccatcgacggcgagtaccggctgcgcggggaggcccggaagaccttcgtggagctcatgcgccggggcgacctgcccgtctggctgagctacaaggtggcgtccgagggcttccagtacagcgaccgccggtggtgcttcgacggggagcgcaacaaccaggtgctcgaggagaacatggacgtcgagatctggaccaaggagggcgagcggaagaagctgcgcccgcggtggctggacgcccgcacctactccgaccccctcgccctgcgggagttcaaggagttcgccgccgggcgccggagcgtgagcggcgacctgatcctcgagatcggcaagctgccccagcacctgacctcccgcgcgcagaacgccctcgacaacctggtgatgctgcacaacagcgagcagggcgggaaggcctaccggcacgccatggaggagctccccgacacgatcgagaccctgatgctgctcgcgctgatcgccgtcctgaccgggggcgtgaccctcttcttcctgtccgggaagggcctgggcaagacgagcatcgggctcctgtgcgtgaccgcctccagcgccctgctctggatggcctccgtcgagccgcactggatcgcggccagcatcatcctggagttcttcctgatggtgctcctgatccccgagcccgaccgccagcggaccccgcaggacaaccagctggcctacgtggtcatcggcctcctgttcatgatcctgaccgtggccgccaacgagatggggctcctggagacgaccaagaaggacctgggcatcgggcacgtggcggccgagaaccaccagcacgccaccatgctcgacgtcgacctgcgccccgcctccgcctggaccctgtacgcggtggccacgaccgtgatcacccccatgatgcggcacaccatcgagaacacgaccgccaacatcagcctcaccgccatcgccaaccaggcggccatcctgatgggcctggacaagggctggcccatctccaagatggacatcggggtcccgctcctggccctgggctgctacagccaggtgaaccccctcaccctgacggccgcggtgctgatgctcgtcgcccactacgccatcatcgggcccggcctgcaggccaaggccacccgcgaggcgcagaagcgcaccgccgccgggatcatgaagaaccccaccgtggacggcatcgtggccatcgacctggacccggtcgtgtacgacgccaagttcgagaagcagctcggccagatcatgctgctgatcctctgcacgtcccagatcctgctgatgcggaccacctgggcgctctgcgagagcatcaccctggccacggggcccctgaccaccctctgggagggctcccccgggaagttctggaacaccacgatcgccgtgagcatggccaacatcttccgcggctcctacctggccggcgcggggctggccttcagcctcatgaagtccctgggcgggggccggcgcgggaccggcgcccagggcgagaccctgggggagaagtggaagcggcagctcaaccagctgagcaagagcgagttcaacacctacaagcgctccggcatcatggaggtcgaccggagcgaggccaaggaggggctgaagcgcggcgagacgaccaagcacgcggtgtcccgggggaccgccaagctccgctggttcgtggagcggaacctggtcaagcccgagggcaaggtgatcgacctgggctgcgggcgcggcgggtggagctactactgcgccggcctgaagaaggtgaccgaggtcaaggggtacaccaagggcggcccggggcacgaggagcccatccccatggccacgtacggctggaacctcgtgaagctgcactccgggaaggacgtgttcttcatgcccccggagaagtgcgacaccctgctctgcgacatcggcgagagctcccccaaccccaccatcgaggaggggcggaccctgcgcgtcctgaagatggtggagccctggctccggggcaaccagttctgcatcaagatcctgaacccgtacatgcccagcgtggtcgagacgctggagcagatgcagcgcaagcacggcgggatgctcgtgcggaaccccctgtcccgcaacagcacccacgagatgtactgggtgtcctgcggcaccgggaacatcgtcagcgccgtgaacatgacctcccggatgctgctcaaccgcttcacgatggcgcaccgcaagcccacctacgagcgggacgtggacctgggcgccggcacccgccacgtcgccgtggagccggaggtggccaacctggacatcatcgggcagcggatcgagaacatcaagaacgagcacaagagcacctggcactacgacgaggacaacccctacaagacgtgggcctaccacggctcctacgaggtcaagcccagcgggtccgcgagctccatggtgaacggcgtggtccgcctcctgaccaagccctgggacgtgatcccgatggtcacccagatcgccatgaccgacacgacccccttcgggcagcagcgggtgttcaaggagaaggtggacacccgcacgccccgggccaagcgcggcacgacccagatcatggaggtcaccgccaagtggctgtggggcttcctcagccggaacaagaagccgcgcatctgcacccgggaggagttcacgcgcaaggtgcggagcaacgccgcgatcggggccgtgttcgtcgacgagaaccagtggaactccgccaaggaggccgtggaggacgagcgcttctgggacctggtgcaccgggagcgcgagctgcacaagcagggcaagtgcgcgacctgcgtctacaacatgatggggaagcgggagaagaagctcggcgagttcgggaaggccaagggcagccgcgccatctggtacatgtggctgggcgcccggttcctggagttcgaggccctcgggttcatgaacgaggaccactggttctcccgcgagaacagcctgtccggcgtggagggggagggcctgcacaagctcgggtacatcctgcgggacatcagcaagatccccggcggcaacatgtacgcggacgacaccgccgggtgggacacccgcatcacggaggacgacctgcagaacgaggccaagatcaccgagatcatggagcccgagcacgccctcctggccacctccatcttcaagctgacctaccagaacaaggtggtccgcgtgcagcggcccgcgaagaacggcacggtgatggacgtcatcagccgccgggaccagcgcgggtccggccaggtgggcacctacgggctcaacaccttcaccaacatggaggtgcagctgatccggcagatggagagcgagggcatcttcctgccgtccgagctcgagacgcccaacctggccgagcgcgtcctggactggctcgagaagcacggggccgagcggctgaagcgcatggccatcagcggcgacgactgcgtggtgaagcccatcgacgaccggttcgccaccgcgctgaccgccctcaacgacatggggaaggtccgcaaggacatcccccagtgggagccgtccaagggctggaacgactggcagcaggtccccttctgcagccaccacttccaccagctgatcatgaaggacggccgggagatcgtggtcccctgccgcaaccaggacgagctggtggggcgggcccgcgtgtcccagggcgccgggtggagcctccgggagaccgcctgcctgggcaagtcctacgcgcagatgtggcagctgatgtacttccaccgccgggacctccgcctggccgccaacgccatctgcagcgcggtccccgtggactgggtgccgaccagccggacgacctggtccatccacgcccaccaccagtggatgaccaccgaggacatgctgagcgtctggaaccgcgtgtggatcgaggagaacccctggatggaggacaagacgcacgtgtccagctgggaggaggtcccctacctcgggaagcgcgaggaccagtggtgcggctccctgatcggcctgaccgcccgggccacctgggccaccaacatccaggtggcgatcaaccaggtgcgccggctcatcgggaacgagaactacctggactacatgacgagcatgaagcgcttcaagaacgagtccgaccccgagggcgccctgtggtga

SEQ ID NO: 8086 - RNA, 9879 nt, synthetic construct
  misc_feature 1..9879: note = derived and/or modified CDS sequence (opt1) from DENV-1__GQ868519__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctgttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttcctcacccaggacgagaagggggtgacgcagaacggccgcctgatcaccgccaacccgatcgtgaccgacaaggagaagcccgtcaacatcgagaccgagccgcccttcggggagtcctacatcgtggtgggcgccggcgagaaggcgctgaagctcagctggttcaagaaggggtccagcatcggcaagatgttcgaggccacggcccgcggggcccgccggatggccatcctgggcgacaccgcgtgggacttcgggtccatcggcggcgtcttcaccagcgtggggaagctggtgcaccaggtcttcggcaccgcctacggggtcctgttctccggcgtgagctggacgatgaagatcgggatcggcatcctgctgacctggctcggcctgaactcccgcagcacctccctgagcatgacctgcatcgccgtcgggatggtgacgctctacctgggcgtgatggtccaggccgactccgggtgcgtgatcaactggaagggccgcgagctgaagtgcgggagcggcatcttcgtgaccaacgaggtccacacctggaccgagcagtacaagttccaggccgactccccgaagcggctcagcgcggccatcggcaaggcctgggaggagggggtgtgcggcatccgcagcgccacccggctggagaacatcatgtggaagcagatctccaacgagctgaaccacatcctcctggagaacgacatgaagttcacggtggtcgtgggggacgccaacggcatcctggcgcaggggaagaagatgatccgcccccagcccatggagcacaagtacagctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctcaagctgcgcgacagctacacccagatgtgcgaccaccggctgatgtccgcggccatcaaggacagcaaggccgtccacgccgacatgggctactggatcgagtccgagaagaacgagacctggaagctcgcccgcgcgagcttcatcgaggtgaagacgtgcacctggcccaagtcccacaccctgtggagcaacggcgtgctggagtccgagatgatcatccccaagatctacgggggcccgatcagccagcacaactaccggcccgggtacttcacccagacggccggcccctggcacctcgggaagctggagctggacttcgacctctgcgagggcaccaccgtcgtggtggacgagcactgcggcaaccgcgggccgtccctgcggaccacgaccgtcaccggcaagatcatccacgagtggtgctgccgcagctgcaccctgccgcccctccggttccgcggggaggacggctgctggtacgggatggagatccggcccgtgaaggagaaggaggagaacctggtgcgctccatggtcagcgccggctccggcgaggtggacagcttcagcctggggatcctctgcgcctccatcatgatcgaggaggtgatgcggagccgctggtcccggaagatgctgatgacgggcaccctggccgtcttcctcctgctggtgatggggcagctcacctggaacgacctgatccgcctgtgcatcatggtgggcgcgaacgccagcgaccgcatggggatgggcaccacgtacctcgccctgatggccaccttcaagatgcggccgatgttcgccgtcgggctcctcttccgccggctgacctcccgcgaggtgctgctcctgaccatcgggctgagcctcgtggcgtccgtcgagctgcccaacagcctggaggagctcggcgacgggctggccatgggcatcatgatgctgaagctcctgacggagttccagccccaccagctgtggatcaccctcctgtccctgaccttcatcaagaccacgctcagcctggactacgcctggaagaccaccgccatggcgctgtccatcgtgagcctcttccccctgtgcctgtccaccacgagccagaagaccacctggctcccggtcctgctgggctccttcgggtgcaagcccctcaccatgttcctgatcaccgagaacaagatctggggccgcaagagctggcccctgaacgaggggatcatggccatcggcatcgtgtccatcctcctgagctccctgctcaagaacgacgtgcccctggccgggccgctgatcgccggcggcatgctcatcgcctgctacgtcatcagcgggagctccgcggacctgagcctggagaaggccgccgaggtgtcctgggagcaggaggccgagcacagcggcacgtcccacaacatcctcgtggaggtccaggacgacgggaccatgaagatcaaggacgaggagcgcgacgacaccctgaccatcctgctcaaggccacgctgctggcggtgagcggcgtgtaccccatgtccatccccgccaccctcttcgtctggtacttctggcagaagaagaagcagcggagcggggtgctgtgggacaccccctccccgcccgaggtggagcgcgccgtcctggacgacggcatctaccggatcctgcagcgcggcctcctggggcggagccaggtgggcgtgggggtcttccaggacggcgtgttccacaccatgtggcacgtgacgcgcggggccgtcctgatgtaccagggcaagcggctcgagccctcctgggccagcgtgaagaaggacctgatctcctacggcgggggctggcgcttccaggggagctggaacaccggcgaggaggtgcaggtcatcgcggtggagcccgggaagaacccgaagaacgtgcagaccatgcccggcaccttcaagacgcccgagggcgaggtcggggccatcgccctggacttcaagcccggcacctccgggagcccgatcgtgaaccgggagggcaagatcgtgggcctctacgggaacggcgtcgtgaccacctccgggacgtacgtgagcgccatcgcccaggcgaaggcctcccaggagggccccctgcccgagatcgaggacgaggtcttcaagaagcgcaacctgaccatcatggacctccacccggggagcggcaagacccggcgctacctgcccgccatggtgcgggaggccatcaagcgcaagctgcggaccctcatcctggcgcccacgcgcgtggtcgccagcgagatggccgaggccctgaagggcatgcccatccgctaccagaccaccgccgtgaagtccgagcacaccgggcgggagatcgtggacctcatgtgccacgcgacgttcaccatgcgcctgctgagcccggtccgggtgcccaactacaacatgatcatcatggacgaggcccacttcaccgaccccgcctccatcgccgcccgcggctacatcagcacccgggtggggatgggcgaggcggccgccatcttcatgacggccacgccgcccgggtccgtcgaggccttcccccagagcaacgcggtgatccaggacgaggagcgcgacatccccgagcggtcctggaacagcggctacgactggatcaccgacttccccggcaagaccgtgtggttcgtcccctccatcaagagcgggaacgacatcgccaactgcctccgcaagaacggcaagcgggtgatccagctgtcccgcaagacgttcgacaccgagtaccagaagaccaagaacaacgactgggactacgtggtcaccacggacatcagcgagatgggggccaacttccgggccgaccgcgtgatcgacccccggcgctgcctgaagcccgtgatcctcaaggacggccccgagcgggtcatcctggcggggccgatgcccgtgaccgtggcctccgccgcccagcgccggggccgcatcggccggaaccagaacaaggagggggaccagtacgtctacatgggccagcccctgaacaacgacgaggaccacgcccactggaccgaggcgaagatgctcctggacaacatcaacacccccgaggggatcatcccggccctgttcgagcccgagcgcgagaagtccgccgccatcgacggcgagtaccgcctccgcggggaggcccgcaagacgttcgtggagctgatgcggcgcggcgacctgcccgtctggctctcctacaaggtggcgagcgagggcttccagtactccgaccggcgctggtgcttcgacggggagcggaacaaccaggtgctggaggagaacatggacgtcgagatctggaccaaggagggcgagcgcaagaagctgcggccccgctggctcgacgcccggacctacagcgacccgctggccctgcgcgagttcaaggagttcgccgccgggcggcgctccgtgagcggcgacctcatcctggagatcggcaagctgccccagcacctcaccctgcgggcgcagaacgccctggacaacctcgtgatgctgcacaacagcgagcagggcgggaaggcctaccgccacgccatggaggagctgcccgacaccatcgagacgctcatgctgctggcgctcatcgccgtcctgaccgggggcgtgaccctgttcttcctctccgggaagggcctgggcaagaccagcatcgggctgctctgcgtgacggcctccagcgccctgctgtggatggcctccgtcgagccccactggatcgcggccagcatcatcctcgagttcttcctgatggtgctgctcatcccggagcccgaccggcagcgcacgccccaggacaaccagctggcctacgtggtcatcggcctcctcttcatgatcctgaccgtggccgccaacgagatggggctgctcgagaccacgaagaaggacctgggcatcgggcacgtggcggccgagaaccaccagcacgccaccatgctggacgtcgacctccggccggcctccgcctggaccctgtacgcggtggccaccacggtgatcacccccatgatgcgccacaccatcgagaacaccacggccaacatcagcctgaccgccatcgccaaccaggcggccatcctcatgggcctggacaagggctggcccatctccaagatggacatcggggtccccctgctcgccctgggctgctacagccaggtgaacccgctgaccctcaccgccgcggtgctgatgctggtcgcccactacgccatcatcgggcccggcctccaggccaaggccacgcgggaggcgcagaagcgcaccgccgccgggatcatgaagaaccccaccgtggacggcatcgtggccatcgacctggaccccgtcgtgtacgacgccaagttcgagaagcagctgggccagatcatgctcctgatcctgtgcacctcccagatcctcctgatgcgcacgacctgggcgctgtgcgagagcatcaccctcgccaccgggccgctgacgaccctgtgggagggctcccccgggaagttctggaacaccaccatcgccgtgagcatggccaacatcttccggggctcctacctcgccggcgcggggctggccttcagcctgatgaagtccctcggcgggggccgccgggggacgggcgcccagggcgagaccctgggggagaagtggaagcgccagctgaaccagctcagcaagtccgagttcaacacctacaagcggagcggcatcatggaggtcgaccgcagcgaggccaaggaggggctgaagcggggcgagaccacgaagcacgcggtgtcccgcgggaccgccaagctgcggtggttcgtggagcgcaacctggtcaagcccgagggcaaggtgatcgacctcggctgcgggcggggcgggtggagctactactgcgccggcctgaagaaggtgaccgaggtcaaggggtacaccaagggcggccccgggcacgaggagccgatccccatggccacctacggctggaacctggtgaagctccactccgggaaggacgtgttcttcatgccgcccgagaagtgcgacacgctgctgtgcgacatcggcgagagctccccgaaccccaccatcgaggaggggcgcaccctccgggtcctgaagatggtggagccctggctgcgcggcaaccagttctgcatcaagatcctcaacccctacatgccgagcgtggtcgagaccctggagcagatgcagcggaagcacggcgggatgctggtgcgcaaccccctctcccggaacagcacgcacgagatgtactgggtgtcctgcggcaccgggaacatcgtcagcgccgtgaacatgacctcccgcatgctgctgaaccggttcaccatggcgcaccgcaagcccacgtacgagcgcgacgtggacctcggcgccggcacccggcacgtcgccgtggagcccgaggtggccaacctggacatcatcgggcagcgcatcgagaacatcaagaacgagcacaagagcacctggcactacgacgaggacaacccgtacaagacctgggcctaccacggctcctacgaggtcaagcccagcgggtccgcgagctccatggtgaacggcgtggtccggctgctcacgaagccctgggacgtgatccccatggtcacccagatcgccatgaccgacaccacgccgttcgggcagcagcgcgtgttcaaggagaaggtggacacccggacgccccgggccaagcggggcaccacgcagatcatggaggtcaccgccaagtggctgtggggcttcctgagccgcaacaagaagccccggatctgcacccgcgaggagttcacccggaaggtgcgctccaacgccgcgatcggggccgtgttcgtcgacgagaaccagtggaacagcgccaaggaggccgtggaggacgagcggttctgggacctcgtgcaccgcgagcgggagctgcacaagcagggcaagtgcgcgacgtgcgtctacaacatgatggggaagcgcgagaagaagctgggcgagttcgggaaggccaagggcagccgggccatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatcccgggcggcaacatgtacgcggacgacaccgccgggtgggacacccggatcaccgaggacgacctgcagaacgaggccaagatcacggagatcatggagcccgagcacgccctgctcgccacctccatcttcaagctgacctaccagaacaaggtggtccgcgtgcagcgccccgcgaagaacggcaccgtgatggacgtcatcagccggcgcgaccagcgggggtccggccaggtgggcacgtacgggctgaacaccttcaccaacatggaggtgcagctcatccgccagatggagagcgagggcatcttcctgccctccgagctggagaccccgaacctcgccgagcgggtcctggactggctggagaagcacggggccgagcgcctcaagcggatggccatcagcggcgacgactgcgtggtgaagcccatcgacgaccgcttcgccacggcgctgaccgccctgaacgacatggggaaggtccggaaggacatcccccagtgggagccctccaagggctggaacgactggcagcaggtcccgttctgcagccaccacttccaccagctcatcatgaaggacggccgcgagatcgtggtcccctgccggaaccaggacgagctggtggggcgcgcccgggtgtcccagggcgccgggtggagcctgcgcgagaccgcctgcctcggcaagtcctacgcgcagatgtggcagctgatgtacttccaccggcgcgacctgcggctcgccgccaacgccatctgcagcgcggtccccgtggactgggtgcccacctcccgcaccacgtggagcatccacgcccaccaccagtggatgaccaccgaggacatgctgagcgtctggaaccgggtgtggatcgaggagaacccgtggatggaggacaagacccacgtgtccagctgggaggaggtcccctacctggggaagcgcgaggaccagtggtgcggctccctcatcggcctgacggcccgcgccacctgggccaccaacatccaggtggcgatcaaccaggtgcggcgcctgatcgggaacgagaactacctcgactacatgaccagcatgaagcggttcaagaacgagtccgaccccgagggcgccctgtggtga

SEQ ID NO: 8087 - RNA, 9879 nt, synthetic construct
  misc_feature 1..9879: note = derived and/or modified CDS sequence (opt1) from DENV-1__KF955443__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctgttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagatgagcggcaccaccaccatcttcgccgggcacctgaagtgccggctgaagatggacaagctcacgctgaagggcacctcctacgtgatgtgcaccgggagcttcaagctggagaaggaggtcgcggagacccagcacggcacggtgctggtgcaggtcaagtacgagggcaccgacgccccctgcaagatccccttctccacccaggacgagaagggggtgacccagaacggccgcctcatcacggccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtcttcacctccgtggggaagctggtgcaccaggtcttcggcaccgcctacggggtgctgttcagcggcgtgtcctggaccatgaagatcgggatcggcatcctcctgacgtggctgggcctcaacagccgctccaccagcctgtccatgacctgcatcgccgtcgggatggtgaccctgtacctcggcgtgatggtccaggccgacagcgggtgcgtgatcaactggaagggccgcgagctgaagtgcgggtccggcatcttcgtgacgaacgaggtccacacctggaccgagcagtacaagttccaggccgacagcccgaagcggctgagcgcggccatcggcaaggcctgggaggagggggtgtgcggcatccgctccgtgacccggctcgagaacatcatgtggaagcagatcagcaacgagctgaaccacatcctgctcgagaacgacatgaagttcaccgtcgtggtgggggacgccaacggcatcctggcccaggggaagaagatgatccgcccccagcccatggagcacaagtactcctggaagtcctggggcaaggcgaagatcatcggcgccgacatccagaacacgaccttcatcatcgacgggcccgacaccccggagtgccccgacaaccagcgggcctggaacatctgggaggtcgaggactacggcttcgggatcttcaccacgaacatctggctgaagctccgcgactcctacacccagatgtgcgaccaccggctgatgagcgccgcgatcaaggactccaaggccgtgcacgccgacatgggctactggatcgagagcgagaagaacgagacctggaagctggcccgcgcctccttcatcgaggtgaagacctgcacgtggcccaagagccacaccctctggtccaacggcgtcctggagagcgagatgatcatccccaagatctacgggggcccgatctcccagcacaactaccggcccgggtacttcacccagaccgcgggcccctggcacctggggaagctcgagctggacttcgacctgtgcgagggcacgaccgtggtggtcgacgagcactgcggcaaccgcgggccgagcctccggaccaccacggtgaccggcaagatcatccacgagtggtgctgccgctcctgcaccctgccgcccctgcggttccgcggggaggacggctgctggtacgggatggagatccggcccgtgaaggagaaggaggagaacctcgtccgcagcatggtgtccgccggcagcggcgaggtggacagcttctccctggggatcctgtgcgccagcatcatgatcgaggaggtcatgcggtcccgctggagccggaagatgctcatgaccggcacgctggccgtgttcctgctcctgatcatggggcagctgacctggaacgacctcatccgcctgtgcatcatggtgggcgccaacgcgtccgaccgcatggggatgggcaccacctacctggccctcatggccacgttcaagatgcggccgatgttcgccgtcgggctgctgttccgccggctcaccagccgcgaggtgctgctgctcaccatcgggctgtccctggtggccagcgtcgagctccccaactccctggaggagctgggcgacgggctcgcgatgggcatcatgatgctgaagctgctcaccgagttccagccccaccagctgtggacgaccctgctcagcctgaccttcatcaagaccacgctgtccctcgactacgcctggaagaccaccgccatggccctgagcatcgtgtccctgttccccctctgcctgagcaccacgtcccagaagaccacctggctgccggtcctcctgggcagcttcgggtgcaagcccctgaccatgttcctcatcaccgagaacaagatctggggccggaagtcctggcccctgaacgaggggatcatggcgatcggcatcgtgagcatcctgctctccagcctgctgaagaacgacgtgcccctcgccgggccgctgatcgccggcggcatgctgatcgcctgctacgtcatcagcgggtccagcgccgacctctccctggagaaggcggccgaggtgagctgggagcaggaggccgagcactccggcacgagccacaacatcctggtggaggtccaggacgacgggaccatgaagatcaaggacgaggagcgcgacgacaccctcaccatcctgctgaaggccacgctcctggccgtgtccggcgtgtaccccatgagcatccccgcgaccctgttcctctggtacttctggcagaagaagaagcagcggtccggggtcctgtgggacacccccagcccgcccgaggtggagcgcgccgtgctggacgacggcatctaccggatcctgcagcgcggcctcctggggcggtcccaggtcggcgtgggggtgttccaggacggcgtcttccacaccatgtggcacgtgacgcgcggggccgtgctgatgtaccagggcaagcggctcgagcccagctgggcctccgtcaagaaggacctgatcagctacggcgggggctggcgcttccaggggtcctggaacaccggcgaggaggtccaggtgatcgccgtcgagcccgggaagaacccgaagaacgtgcagaccacccccggcacgttcaagacccccgagggcgaggtgggggcgatcgccctggacttcaagcccggcaccagcgggtccccgatcgtcaaccgggagggcaagatcgtgggcctctacgggaacggcgtggtcaccacgagcgggacctacgtgtccgccatcgcccaggccaaggcgagccaggagggccccctgcccgagatcgaggacgaggtgttcaagaagcgcaacctgaccatcatggacctccacccggggagcggcaagacccggcgctacctgcccgccatcgtccgggaggccatcaagcgcaagctgcggacgctcatcctggcccccacccgcgtggtggcgtccgagatggccgaggccctgaagggcatgcccatccgctaccagaccaccgccgtcaagagcgagcacacggggcgggagatcgtggacctcatgtgccacgccaccttcaccatgcgcctgctgtccccggtgcgggtccccaactacaacatgatcatcatggacgaggcgcacttcaccgaccccgccagcatcgccgcccgcggctacatctccacgcgggtggggatgggcgaggccgcggccatcttcatgaccgccacgccgcccgggagcgtggaggccttcccccagtccaacgccgtcatccaggacgaggagcgcgacatccccgagcggagctggaactccggctacgactggatcaccgacttccccggcaagacggtgtggttcgtgcccagcatcaagtccgggaacgacatcgcgaactgcctccgcaagaacggcaagcgggtcatccagctgagccgcaagaccttcgacaccgagtaccagaagaccaagaacaacgactgggactacgtggtgacgaccgacatctccgagatgggggccaacttccgggccgaccgcgtcatcgacccccggcgctgcctgaagcccgtgatcctcaaggacggccccgagcgggtgatcctggccgggccgatgcccgtcaccgtggcgagcgccgcccagcgccggggccgcatcggccggaaccagaacaaggagggggaccagtacgtgtacatgggccagcccctgaacaacgacgaggaccacgcccactggaccgaggccaagatgctcctggacaacatcaacacgcccgaggggatcatcccggcgctgttcgagcccgagcgcgagaagtccgccgccatcgacggcgagtaccgcctccgcggggaggcccgcaagaccttcgtcgagctgatgcggcgcggcgacctgcccgtgtggctcagctacaaggtcgcctccgagggcttccagtacagcgaccggcgctggtgcttcgacggggagcggaacaaccaggtgctggaggagaacatggacgtggagatctggaccaaggagggcgagcgcaagaagctgcggccccgctggctcgacgcgcggacctactccgacccgctggccctgcgcgagttcaaggagttcgccgccgggcggcgcagcgtcagcggcgacctcatcctggagatcggcaagctgccccagcacctcaccctgcgggcccagaacgcgctggacaacctcgtgatgctgcacaactccgagcagggcgggaaggcctaccgccacgccatggaggagctgcccgacacgatcgagaccctcatgctgctggccctcatcgcggtgctgaccgggggcgtcaccctgttcttcctcagcgggaagggcctgggcaagacgtccatcgggctgctctgcgtgaccgccagctccgccctgctgtggatggccagcgtggagccccactggatcgccgcgtccatcatcctcgagttcttcctgatggtcctgctcatcccggagcccgaccggcagcgcacgccccaggacaaccagctggcctacgtggtgatcggcctcctcttcatgatcctgaccgtcgccgccaacgagatggggctgctcgagacgaccaagaaggacctgggcatcgggcacgtggccgcggagaaccaccagcacgccaccatgctggacgtggacctccggccggccagcgcctggaccctgtacgccgtcgcgacgaccgtgatcacccccatgatgcgccacaccatcgagaacacgaccgccaacatctccctgaccgccatcgccaaccaggccgcgatcctcatgggcctggacaagggctggcccatcagcaagatggacatcggggtgcccctgctcgccctgggctgctactcccaggtcaacccgctgaccctcacggccgccgtgctgatgctggtggcgcactacgccatcatcgggcccggcctccaggccaaggccacccgggaggcccagaagcgcaccgcggccgggatcatgaagaaccccaccgtcgacggcatcgtggccatcgacctggaccccgtggtctacgacgccaagttcgagaagcagctgggccagatcatgctcctgatcctgtgcacgagccagatcctcctgatgcgcaccacctgggccctgtgcgagtccatcaccctcgcgacggggccgctgaccaccctgtgggagggcagccccgggaagttctggaacaccacgatcgccgtgtccatggccaacatcttccggggcagctacctcgccggcgccgggctggcgttctccctgatgaagtccctcggcgggggccgccgggggaccggcgcccagggcgagaccctgggggagaagtggaagcgccagctgaaccagctctccaagagcgagttcaacacctacaagcggagcggcatcatggaggtggaccgctccgaggccaaggaggggctgaagcggggcgagacgaccaagcacgccgtcagccgcgggaccgcgaagctgcggtggttcgtggagcgcaacctggtgaagcccgagggcaaggtcatcgacctcggctgcgggcggggcgggtggtcctactactgcgccggcctgaagaaggtgaccgaggtgaaggggtacaccaagggcggccccgggcacgaggagccgatccccatggccacgtacggctggaccctggtcaagctccacagcgggaaggacgtgttcttcatgccgcccgagaagtgcgacaccctgctgtgcgacatcggcgagtccagcccgaaccccaccatcgaggaggggcgcacgctccgggtgctgaagatggtcgagccctggctgcgcggcaaccagttctgcatcaagatcctcaacccctacatgccgtccgtggtggagaccctggagcagatgcagcggaagcacggcgggatgctggtccgcaaccccctcagccggaactccacccacgagatgtactgggtgagctgcggcaccgggaacatcgtgtccgccgtcaacatgacgagccgcatgctgctgaaccggttcaccatggcccaccgcaagcccaccttcgagcgcgacgtggacctcggcgcgggcacccggcacgtggccgtcgagcccgaggtggccaacctggacatcatcgggcagcgcatcgagaacatcaagaacgagcacaagtccacgtggcactacgacgaggacaacccgtacaagacctgggcctaccacggcagctacgaggtgaagccctccgggagcgcctccagcatggtcaacggcgtggtgcggctgctcaccaagccctgggacgtcatccccatggtgacccagatcgcgatgacggacaccaccccgttcgggcagcagcgcgtcttcaaggagaaggtggacacccggacgccccgcgccaagcggggcaccacccagatcatggaggtgaccgccaagtggctgtggggcttcctgtcccgcaacaagaagccccggatctgcacgcgcgaggagttcacccggaaggtccgcagcaacgccgccatcggggcggtgttcgtggacgagaaccagtggaacagcgccaaggaggccgtcgaggacgagcggttctgggacctcgtgcaccgcgagcgggagctgcacaagcagggcaagtgcgcgacctgcgtgtacaacatgatggggaagcgcgagaagaagctgggcgagttcgggaaggcgaagggctcccgggccatctggtacatgtggctcggcgcccgcttcctggagttcgaggccctggggttcatgaacgaggaccactggttcagccgggagaactccctcagcggcgtcgagggggagggcctgcacaagctggggtacatcctccgcgacatctccaagatcccgggcggcaacatgtacgccgacgacaccgcggggtgggacacgcggatcaccgaggacgacctgcagaacgaggccaagatcaccgacatcatggagcccgagcacgccctgctcgccaccagcatcttcaagctgacgtaccagaacaaggtggtgcgcgtccagcgccccgccaagaacggcaccgtgatggacgtgatctcccggcgcgaccagcgggggagcggccaggtcggcacctacgggctgaacaccttcacgaacatggaggtgcagctcatccgccagatggagtccgagggcatcttcctgcccagcgagctggagaccccgaacctcgcggagcgggtgctggactggctggagaagcacggggccgagcgcctcaagcggatggccatctccggcgacgactgcgtcgtgaagcccatcgacgaccgcttcgccaccgccctgaccgcgctgaacgacatggggaaggtgcggaaggacatcccccagtgggagcccagcaagggctggaacgactggcagcaggtcccgttctgctcccaccacttccaccagctcatcatgaaggacggccgcgagatcgtggtgccctgccggaaccaggacgagctggtcgggcgcgcccgggtgagccagggcgccgggtggtccctgcgcgagaccgcctgcctcggcaagagctacgcccagatgtggcagctgatgtacttccaccggcgcgacctgcggctcgcggccaacgccatctgctccgccgtgcccgtcgactgggtgcccacgagccgcaccacctggagcatccacgcgcaccaccagtggatgaccacggaggacatgctgtccgtgtggaaccgggtctggatcgaggagaacccgtggatggaggacaagacccacgtgagctcctgggaggaggtgccctacctggggaagcgcgaggaccagtggtgcggcagcctcatcggcctgaccgcccgcgccacctgggccacgaacatccaggtcgccatcaaccaggtgcggcgcctgatcgggaacgagaactacctcgactacatgacctccatgaagcggttcaagaacgagagcgaccccgagggcgcgctgtggtga

SEQ ID NO: 8088 - RNA, 9879 nt, synthetic construct
  misc_feature 1..9879: note = derived and/or modified CDS sequence (opt1) from DENV-1__GQ868520__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctggtgatggggcagctgacctggaacgacctcatccgcctgtgcatcatggtgggcgcgaacgcctccgaccgcatggggatgggcaccacgtacctggccctcatggccaccttcaagatgcggccgatgttcgccgtcgggctgctgttccgccggctcaccagccgcgaggtgctgctgctcaccatcgggctgtccctggtggcgagcgtcgagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtgtccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggtccagcgcggacctctccctggagaaggccgccgaggtgagctgggagcaggaggccgagcactccggcaccagccacaacatcctggtggaggtccaggacgacgggaccatgaagatcaaggacgaggagcgcgacgacaccctcacgatcctgctgaaggccaccctcctggcggtgtccggcgtgtaccccatgagcatccccgccaccctgttcgtctggtacttctggcagaagaagaagcagcggtccggggtgctctgggacacccccagcccgcccgaggtggagcgcgccgtcctggacgacggcatctaccggatcctgcagcgcggcctgctcgggcggtcccaggtgggcgtgggggtcttccaggacggcgtgttccacacgatgtggcacgtgacccgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgcggtggagcccgggaagaacccgaagaacgtgcagaccatgcccggcacgttcaagacccccgagggcgaggtcggggccatcgccctggacttcaagcccggcaccagcgggtccccgatcgtgaaccgggagggcaagatcgtgggcctgtacgggaacggcgtcgtgaccacgagcgggacctacgtgtccgccatcgcccaggcgaaggccagccaggagggccccctccccgagatcgaggacgaggtcttcaagaagcgcaacctgaccatcatggacctgcacccggggagcggcaagacccggcgctacctccccgccatggtgcgggaggccatcaagcgcaagctgcggacgctgatcctcgcgcccacccgcgtggtcgcctccgagatggccgaggccctgaagggcatgcccatccgctaccagaccaccgccgtcaagagcgagcacacggggcgggagatcgtggacctgatgtgccacgcgaccttcaccatgcgcctcctgtccccggtccgggtgcccaactacaacatgatcatcatggacgaggcccacttcaccgaccccgccagcatcgccgcccgcggctacatctccacgcgggtggggatgggcgaggcggccgccatcttcatgaccgccacgccgcccgggagcgtcgaggccttcccccagtccaacgcggtgatccaggacgaggagcgcgacatccccgagcggagctggaactccggctacgactggatcaccgacttccccggcaagacggtgtggttcgtccccagcatcaagtccgggaacgacatcgccaactgcctgcgcaagaacggcaagcgggtgatccagctcagccgcaagaccttcgacaccgagtaccagaagaccaagaacaacgactgggactacgtggtcacgaccgacatctccgagatgggggccaacttccgggccgaccgcgtgatcgacccccggcgctgcctgaagcccgtgatcctgaaggacggccccgagcgggtcatcctcgcggggccgatgcccgtgaccgtggccagcgccgcccagcgccggggccgcatcggccggaaccagaacaaggagggggaccagtacgtctacatgggccagcccctgaacaacgacgaggaccacgcccactggaccgaggcgaagatgctgctcgacaacatcaacacgcccgaggggatcatcccggccctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcgtccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgaccctccgggcgcagaacgccctggacaacctggtgatgctccacaactccgagcagggcgggaaggcctaccgccacgccatggaggagctgcccgacacgatcgagaccctgatgctcctggcgctgatcgccgtcctcaccgggggcgtgaccctgttcttcctgagcgggaagggcctcggcaagacgtccatcgggctgctgtgcgtgaccgccagctccgccctcctgtggatggccagcgtcgagccccactggatcgcggcctccatcatcctggagttcttcctcatggtgctgctgatcccggagcccgaccggcagcgcacgccccaggacaaccagctcgcctacgtggtcatcggcctgctgttcatgatcctcaccgtggccgccaacgagatggggctgctggagacgaccaagaaggacctcggcatcgggcacgtggcggccgagaaccaccagcacgccaccatgctggacgtcgacctgcggccggccagcgcctggaccctctacgcggtggccacgaccgtgatcacccccatgatgcgccacaccatcgagaacacgaccgccaacatctccctgaccgccatcgccaaccaggcggccatcctgatgggcctcgacaagggctggcccatcagcaagatggacatcggggtccccctgctggccctcggctgctactcccaggtgaacccgctgaccctgacggccgcggtgctcatgctggtcgcccactacgccatcatcgggcccggcctgcaggccaaggccacccgggaggcgcagaagcgcaccgccgccgggatcatgaagaaccccaccgtggacggcatcgtggccatcgacctcgaccccgtcgtgtacgacgccaagttcgagaagcagctgggccagatcatgctgctcatcctgtgcacgagccagatcctgctcatgcgcaccacctgggcgctgtgcgagtccatcaccctggccacggggccgctcaccaccctgtgggagggcagccccgggaagttctggaacaccacgatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacctacaagcggagcggcatcatggaggtcgaccgctccgaggccaaggaggggctcaagcggggcgagacgaccaagcacgcggtgagccgcgggaccgccaagctgcggtggttcgtggagcgcaacctggtcaagcccgagggcaaggtgatcgacctgggctgcgggcggggcgggtggtcctactactgcgccggcctcaagaaggtgaccgaggtcaaggggtacaccaagggcggccccgggcacgaggagccgatccccatggccacgtacggctggaacctggtgaagctgcacagcgggaaggacgtgttcttcatgccgcccgagaagtgcgacaccctcctgtgcgacatcggcgagtccagcccgaaccccaccatcgaggaggggcgcaccctgcgggtcctcaagatggtggagccctggctgcgcggcaaccagttctgcatcaagatcctgaacccctacatgccgtccgtggtcgagacgctcgagcagatgcagcggaagcacggcgggatgctggtgcgcaaccccctgagccggaactccacccacgagatgtactgggtgagctgcggcaccgggaacatcgtctccgccgtgaacatgaccagccgcatgctcctgaaccggttcacgatggcgcaccgcaagcccacctacgagcgcgacgtggacctgggcgccggcacccggcacgtcgccgtggagcccgaggtggccaacctcgacatcatcgggcagcgcatcgagaacatcaagaacgagcacaagtccacctggcactacgacgaggacaacccgtacaagacgtgggcctaccacggcagctacgaggtcaagccctccgggagcgcgtccagcatggtgaacggcgtggtccggctgctgaccaagccctgggacgtgatccccatggtcacccagatcgccatgaccgacacgaccccgttcgggcagcagcgcgtgttcaaggagaaggtggacacccggacgccccgggccaagcggggcacgacccagatcatggaggtcaccgccaagtggctctggggcttcctgtcccgcaacaagaagccccggatctgcacccgcgaggagttcacgcggaaggtgcgcagcaacgccgcgatcggggccgtgttcgtcgacgagaaccagtggaacagcgccaaggaggccgtggaggacgagcggttctgggacctggtgcaccgcgagcgggagctccacaagcagggcaagtgcgcgacctgcgtctacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacaccgccgggtgggacacccggatcacggaggacgacctccagaacgaggccaagatcaccgagatcatggagcccgagcacgccctgctggccaccagcatcttcaagctcacctaccagaacaaggtggtccgcgtgcagcgccccgcgaagaacggcacggtgatggacgtcatctcccggcgcgaccagcgggggagcggccaggtgggcacctacgggctgaacaccttcaccaacatggaggtgcagctgatccgccagatggagtccgagggcatcttcctccccagcgagctggagacgccgaacctggccgagcgggtcctcgactggctggagaagcacggggccgagcgcctgaagcggatggccatctccggcgacgactgcgtggtgaagcccatcgacgaccgcttcgccaccgcgctcaccgccctgaacgacatggggaaggtccggaaggacatcccccagtgggagcccagcaagggctggaacgactggcagcaggtcccgttctgctcccaccacttccaccagctgatcatgaaggacggccgcgagatcgtggtcccctgccggaaccaggacgagctcgtggggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgctccgcggtccccgtggactgggtgcccaccagccgcacgacctggagcatccacgcccaccaccagtggatgaccaccgaggacatgctctccgtctggaaccgggtgtggatcgaggagaacccgtggatggaggacaagacgcacgtgagctcctgggaggaggtcccctacctggggaagcgcgaggaccagtggtgcggcagcctgatcggcctcaccgcccgcgccacctgggccaccaacatccaggtggcgatcaaccaggtgcggcgcctgatcgggaacgagaactacctggactacatgacgtccatgaagcggttcaagaacgagagcgaccccgagggcgccctctggtga

SEQ ID NO: 8089 - RNA, 9879 nt, synthetic construct
  misc_feature 1..9879: note = derived and/or modified CDS sequence (opt1) from DENV-1__GQ868522__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctggtgatggggcagctgacctggaacgacctcatccgcctgtgcatcatggtgggcgcgaacgcctccgaccgcatggggatgggcaccacgtacctggccctcatggccaccttcaagatgcggccgatgttcgccgtcgggctgctgttccgccggctcaccagccgcgaggtgctgctgctcaccatcgggctgtccctggtggcgagcgtcgagctccccaactccctggaggagctgggcgacgggctcgccatgggcatcatgatgctgaagctgctcacggagttccagccccaccagctgtggatcaccctgctcagcctgaccttcatcaagaccacgctgtccctcgactacgcctggaagaccaccgccatggcgctgagcatcgtgtccctgttccccctctgcctgagcaccacgtcccagaagaccacctggctgccggtcctcctgggcagcttcgggtgcaagcccctgaccatgttcctcatcaccgagaacaagatctggggccggaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggtccagcgcggacctctccctggagaaggccgccgaggtgagctgggagcaggaggccgagcactccggcacgagccacaacatcctggtggaggtccaggacgacgggaccatgaagatcaaggacgaggagcgcgacgacaccctcaccatcctgctgaaggccacgctcctggcggtgtccggcgtgtaccccatgagcatccccgccaccctgttcgtctggtacttctggcagaagaagaagcagcggtccggggtgctctgggacacccccagcccgcccgaggtggagcgcgccgtcctggacgacggcatctaccggatcctgcagcgcggcctgctcgggcggtcccaggtgggcgtgggggtcttccaggacggcgtgttccacaccatgtggcacgtgacgcgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgcggtggagcccgggaagaacccgaagaacgtgcagaccatgcccggcaccttcaagacgcccgagggcgaggtcggggccatcgccctggacttcaagcccggcaccagcgggtccccgatcgtgaaccgggagggcaagatcgtgggcctgtacgggaacggcgtcgtgaccaccagcgggacgtacgtgtccgccatcgcccaggcgaaggccagccaggagggccccctccccgagatcgaggacgaggtcttcaagaagcgcaacctgaccatcatggacctgcacccggggagcggcaagacccggcgctacctccccgccatggtgcgggaggccatcaagcgcaagctgcggaccctgatcctcgcgcccacgcgcgtggtcgcctccgagatggccgaggccctgaagggcatgcccatccgctaccagaccaccgccgtcaagagcgagcacaccgggcgggagatcgtggacctgatgtgccacgcgacgttcaccatgcgcctcctgtccccggtccgggtgcccaactacaacatgatcatcatggacgaggcccacttcaccgaccccgccagcatcgccgcccgcggctacatctccacccgggtggggatgggcgaggcggccgccatcttcatgacggccacgccgcccgggagcgtcgaggccttcccccagtccaacgcggtgatccaggacgaggagcgcgacatccccgagcggagctggaactccggctacgactggatcaccgacttccccggcaagaccgtgtggttcgtccccagcatcaagtccgggaacgacatcgccaactgcctgcgcaagaacggcaagcgggtgatccagctcagccgcaagacgttcgacaccgagtaccagaagaccaagaacaacgactgggactacgtggtcaccacggacatctccgagatgggggccaacttccgggccgaccgcgtgatcgacccccggcgctgcctgaagcccgtgatcctgaaggacggccccgagcgggtcatcctcgcggggccgatgcccgtgaccgtggccagcgccgcccagcgccggggccgcatcggccggaaccagaacaaggagggggaccagtacgtctacatgggccagcccctgaacaacgacgaggaccacgcccactggaccgaggcgaagatgctgctcgacaacatcaacacccccgaggggatcatcccggccctgttcgagcccgagcgcgagaagtccgccgccatcgacggcgagtaccgcctgcgcggggaggcccgcaagacgttcgtggagctcatgcggcgcggcgacctgcccgtctggctgagctacaaggtggcgtccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgaccctccgggcgcagaacgccctggacaacctggtgatgctccacaactccgagcagggcgggaaggcctaccgccacgccatggaggagctgcccgacaccatcgagacgctgatgctcctggcgctgatcgccgtcctcaccgggggcgtgaccctgttcttcctgagcgggaagggcctcggcaagacctccatcgggctgctgtgcgtgacggccagctccgccctcctgtggatggccagcgtcgagccccactggatcgcggcctccatcatcctggagttcttcctcatggtgctgctgatcccggagcccgaccggcagcgcacgccccaggacaaccagctcgcctacgtggtcatcggcctgctgttcatgatcctcaccgtggccgccaacgagatggggctgctggagaccacgaagaaggacctcggcatcgggcacgtggcggccgagaaccaccagcacgccaccatgctggacgtcgacctgcggccggccagcgcctggaccctctacgcggtggccaccacggtgatcacccccatgatgcgccacaccatcgagaacaccacggccaacatctccctgaccgccatcgccaaccaggcggccatcctgatgggcctcgacaagggctggcccatcagcaagatggacatcggggtccccctgctggccctcggctgctactcccaggtgaacccgctgaccctgaccgccgcggtgctcatgctggtcgcccactacgccatcatcgggcccggcctgcaggccaaggccacgcgggaggcgcagaagcgcaccgccgccgggatcatgaagaaccccaccgtggacggcatcgtggccatcgacctcgaccccgtcgtgtacgacgccaagttcgagaagcagctgggccagatcatgctgctcatcctgtgcaccagccagatcctgctcatgcgcacgacctgggcgctgtgcgagtccatcaccctggccaccgggccgctcacgaccctgtgggagggcagccccgggaagttctggaacaccaccatcgccgtgtccatggccaacatcttccggggcagctacctggccggcgcggggctcgccttctccctgatgaagtccctgggcgggggccgccgggggacgggcgcccagggcgagaccctcggggagaagtggaagcgccagctgaaccagctgtccaagagcgagttcaacacctacaagcggagcggcatcatggaggtcgaccgctccgaggccaaggaggggctcaagcggggcgagaccacgaagcacgcggtgagccgcgggaccgccaagctgcggtggttcgtggagcgcaacctggtcaagcccgagggcaaggtgatcgacctgggctgcgggcggggcgggtggtcctactactgcgccggcctcaagaaggtgaccgaggtcaaggggtacaccaagggcggccccgggcacgaggagccgatccccatggccacctacggctggaacctggtgaagctgcacagcgggaaggacgtgttcttcatgccgcccgagaagtgcgacacgctcctgtgcgacatcggcgagtccagcccgaaccccaccatcgaggaggggcgcaccctgcgggtcctcaagatggtggagccctggctgcgcggcaaccagttctgcatcaagatcctgaacccctacatgccgtccgtggtcgagaccctcgagcagatgcagcggaagcacggcgggatgctggtgcgcaaccccctgagccggaactccacgcacgagatgtactgggtgagctgcggcaccgggaacatcgtctccgccgtgaacatgaccagccgcatgctcctgaaccggttcaccatggcgcaccgcaagcccacgtacgagcgcgacgtggacctgggcgccggcacccggcacgtcgccgtggagcccgaggtggccaacctcgacatcatcgggcagcgcatcgagaacatcaagaacgagcacaagtccacctggcactacgacgaggacaacccgtacaagacctgggcctaccacggcagctacgaggtcaagccctccgggagcgcgtccagcatggtgaacggcgtggtccggctgctgacgaagccctgggacgtgatccccatggtcacccagatcgccatgaccgacaccacgccgttcgggcagcagcgcgtgttcaaggagaaggtggacacccggacgccccgggccaagcggggcaccacgcagatcatggaggtcaccgccaagtggctctggggcttcctgtcccgcaacaagaagccccggatctgcacccgcgaggagttcacccggaaggtgcgcagcaacgccgcgatcggggccgtgttcgtcgacgagaaccagtggaacagcgccaaggaggccgtggaggacgagcggttctgggacctggtgcaccgcgagcgggagctccacaagcagggcaagtgcgcgacgtgcgtctacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacaccgccgggtgggacacccggatcaccgaggacgacctccagaacgaggccaagatcacggagatcatggagcccgagcacgccctgctggccaccagcatcttcaagctcacctaccagaacaaggtggtccgcgtgcagcgccccgcgaagaacggcaccgtgatggacgtcatctcccggcgcgaccagcgggggagcggccaggtgggcacgtacgggctgaacaccttcaccaacatggaggtgcagctgatccgccagatggagtccgagggcatcttcctccccagcgagctggagaccccgaacctggccgagcgggtcctcgactggctggagaagcacggggccgagcgcctgaagcggatggccatctccggcgacgactgcgtggtgaagcccatcgacgaccgcttcgccacggcgctcaccgccctgaacgacatggggaaggtccggaaggacatcccccagtgggagcccagcaagggctggaacgactggcagcaggccccgttctgctcccaccacttccaccagctgatcatgaaggacggccgcgagatcgtggtgccctgccggaaccaggacgagctcgtcgggcgcgcccgggtgagccagggcgccgggtggtccctgcgcgagaccgcgtgcctgggcaagagctacgcccagatgtggcagctcatgtacttccaccggcgcgacctgcggctggccgccaacgcgatctgctccgccgtgcccgtcgactgggtgcccaccagccgcaccacgtggagcatccacgcccaccaccagtggatgaccaccgaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcacggcccgcgccacctgggcgaccaacatccaggtcgccatcaaccaggtgcggcgcctgatcgggaacgagaactacctggactacatgacctccatgaagcggttcaagaacgagagcgaccccgagggcgccctctggtga

SEQ ID NO: 8090 - RNA, 9879 nt, synthetic construct
  misc_feature 1..9879: note = derived and/or modified CDS sequence (opt1) from DENV-1__HQ166036__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccagatcaccgaggccgagcccgacgacgtggactgctggtgcaacgccaccgacacgtgggtgacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctggtgatggggcagctgacctggaacgacctcatccgcctgtgcatcatggtgggcgcgaacgcctccgaccgcatggggatgggcaccacgtacctggccctcatggccaccttcaagatgcggccgatgttcgccgtcgggctgctgttccgccggctcaccagccgcgaggtgctgctgctcaccatcgggctgtccctggtggcgagcgtcgagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtgtccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggtccagcgcggacctctccctggagaaggccgccgaggtgagctgggagcaggaggccgagcactccggcaccagccacaacatcctggtggaggtccaggacgacgggaccatgaagatcaaggacgaggagcgcgacgacaccctcacgatcctgctgaaggccaccctcctggcggtgtccggcgtgtaccccatgagcatccccgccaccctgttcgtctggtacttctggcagaagaagaagcagcggtccggggtgctctgggacacccccagcccgcccgaggtggagcgcgccgtcctggacgacggcatctaccggatcctgcagcgcggcctgctcgggcggtcccaggtgggcgtgggggtcttccaggacggcgtgttccacacgatgtggcacgtgacccgcggggccgtcctgatgtaccagggcaagcggctggagcccagctgggcctccgtgaagaaggacctcatcagctacggcgggggctggcgcttccgggggtcctggaacaccggcgaggaggtgcaggtcatcgcggtggagcccgggaagaacccgaagaacgtgcagaccacgcccggcaccttcaagacccccgagggcgaggtcggggccatcgccctggacttcaagcccggcaccagcgggtccccgatcgtgaaccgcgagggcaagatcgtgggcctgtacgggaacggcgtcgtgacgaccagcgggacctacgtgtccgccatcgcccaggcgaaggccagccaggagggccccctccccgagatcgaggacgaggtcttcaagaagcggaacctgaccatcatggacctgcacccggggagcggcaagacgcgccggtacctccccgccatcgtgcgcgaggccatcaagcggaagctgcgcaccctgatcctcgcgcccacccgcgtggtcgcctccgagatggccgaggccctgaagggcatgcccatccggtaccagaccacggccgtcaagagcgagcacaccgggcgcgagatcgtggacctgatgtgccacgcgaccttcaccatgcggctcctgtccccggtccgcgtgcccaactacaacatgatcatcatggacgaggcccacttcacggaccccgccagcatcgccgcccggggctacatctccacccgcgtggggatgggcgaggcggccgccatcttcatgaccgccacgccgcccgggagcgtcgaggccttcccccagtccaacgcggtgatccaggacgaggagcgggacatccccgagcgcagctggaactccggctacgactggatcacggacttccccggcaagaccgtgtggttcgtccccagcatcaagtccgggaacgacatcgccaactgcctgcggaagaacggcaagcgcgtgatccagctcagccggaagaccttcgacaccgagtaccagaagacgaagaacaacgactgggactacgtggtcaccaccgacatctccgagatgggggccaacttccgcgccgaccgggtgatcgacccccgccggtgcctgaagcccgtgatcctgaaggacggccccgagcgcgtcatcctcgcggggccgatgcccgtgaccgtggccagcgccgcccagcggcgcggccggatcggccgcaaccagaacaaggagggggaccagtacgtctacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccggctgcgcggggaggcccggaagaccttcgtggagctcatgcgccggggcgacctgcccgtctggctgagctacaaggtggcgtccgagggcttccagtacagcgaccgccggtggtgcttcgacggggagcgcaacaaccaggtgctcgaggagaacatggacgtcgagatctggaccaaggagggcgagcggaagaagctgcgcccccggtggctggacgcccgcacctactccgacccgctcgccctgcgggagttcaaggagttcgccgccgggcgccggagcgtgagcggcgacctgatcctcgagatcggcaagctgccccagcacctgacgtcccgcgcgcagaacgccctcgacaacctggtgatgctgcacaacagcgagcagggcgggaaggcctaccggcacgccatggaggagctccccgacaccatcgagaccctgatgctgctcgcgctgatcgccgtcctgaccgggggcgtgaccctcttcttcctgtccgggaagggcctgggcaagaccagcatcgggctcctgtgcgtgaccgcctccagcgccctgctctggatggcctccgtcgagccccactggatcgcggccagcatcatcctggagttcttcctgatggtgctcctgatcccggagcccgaccgccagcggacgccccaggacaaccagctggcctacgtggtcatcggcctcctgttcatgatcctgacggtggccgccaacgagatggggctcctggagaccaccaagaaggacctgggcatcgggcacgtggcggccgagaaccaccagcacgccaccatgctcgacgtcgacctgcgcccggcctccgcctggacgctgtacgcggtggccaccaccgtgatcacccccatgatgcggcacacgatcgagaacaccaccgccaacatcagcctcaccgccatcgccaaccaggcggccatcctgatgggcctggacaagggctggcccatctccaagatggacatcggggtccccctcctggccctgggctgctacagccaggtgaacccgctcacgctgaccgccgcggtgctgatgctcgtcgcccactacgccatcatcgggcccggcctgcaggccaaggccacccgcgaggcgcagaagcgcaccgccgccgggatcatgaagaaccccacggtggacggcatcgtggccatcgacctggaccccgtcgtgtacgacgccaagttcgagaagcagctcggccagatcatgctgctgatcctctgcacctcccagatcctgctgatgcggaccacctgggcgctctgcgagagcatcacgctggccaccgggccgctgaccaccctctgggagggctcccccgggaagttctggaacacgaccatcgccgtgagcatggccaacatcttccgcggctcctacctggccggcgcggggctggccttcagcctcatgaagtccctgggcgggggccggcgcgggaccggcgcccagggcgagaccctgggggagaagtggaagcggcagctcaaccagctgagcaagagcgagttcaacacgtacaagcgctccggcatcatggaggtcgaccggagcgaggccaaggaggggctgaagcgcggcgagaccaccaagcacgcggtgtcccgggggaccgccaagctccgctggttcgtggagcggaacctggtcaagcccgagggcaaggtgatcgacctgggctgcgggcgcggcgggtggagctactactgcgccggcctgaagaaggtgaccgaggtcaaggggtacacgaagggcggccccgggcacgaggagccgatccccatggccacctacggctggaacctcgtgaagctgcactccgggaaggacgtgttcttcatgccgcccgagaagtgcgacaccctgctctgcgacatcggcgagagctccccgaaccccaccatcgaggaggggcggacgctgcgcgtcctgaagatggtggagccctggctccggggcaaccagttctgcatcaagatcctgaacccctacatgccgagcgtggtcgagaccctggagcagatgcagcgcaagcacggcgggatgctcgtgcggaaccccctgtcccgcaacagcacccacgagatgtactgggtgtcctgcggcaccgggaacatcgtcagcgccgtgaacatgacgtcccggatgctgctcaaccgcttcaccatggcgcaccgcaagcccacctacgagcgggacgtggacctgggcgccggcacccgccacgtcgccgtggagcccgaggtggccaacctggacatcatcgggcagcggatcgagaacatcaagaacgagcacaagagcacgtggcactacgacgaggacaacccgtacaagacctgggcctaccacggctcctacgaggtcaagcccagcgggtccgcgagctccatggtgaacggcgtggtccgcctcctgaccaagccctgggacgtgatccccatggtcacccagatcgccatgacggacaccaccccgttcgggcagcagcgggtgttcaaggagaaggtggacacccgcacgccccgggccaagcgcggcaccacccagatcatggaggtcaccgccaagtggctgtggggcttcctcagccggaacaagaagccccgcatctgcacgcgggaggagttcacccgcaaggtgcggagcaacgccgcgatcggggccgtgttcgtcgacgagaaccagtggaactccgccaaggaggccgtggaggacgagcgcttctgggacctggtgcaccgggagcgcgagctgcacaagcagggcaagtgcgcgacctgcgtctacaacatgatggggaagcgggagaagaagctcggcgagttcgggaaggccaagggcagccgcgccatctggtacatgtggctgggcgcccggttcctggagttcgaggccctcgggttcatgaacgaggaccactggttctcccgcgagaacagcctgtccggcgtggagggggagggcctgcacaagctcgggtacatcctgcgggacatcagcaagatcccgggcggcaacatgtacgcggacgacaccgccgggtgggacacgcgcatcaccgaggacgacctgcagaacgaggccaagatcaccgagatcatggagcccgagcacgccctcctggccacctccatcttcaagctgacgtaccagaacaaggtggtccgcgtgcagcggcccgcgaagaacggcaccgtgatggacgtcatcagccgccgggaccagcgcgggtccggccaggtgggcacctacgggctcaacaccttcacgaacatggaggtgcagctgatccggcagatggagagcgagggcatcttcctgccctccgagctcgagaccccgaacctggccgagcgcgtcctggactggctcgagaagcacggggccgagcggctgaagcgcatggccatcagcggcgacgactgcgtggtgaagcccatcgacgaccggttcgccaccgcgctgaccgccctcaacgacatggggaaggtccgcaaggacatcccccagtgggagccctccaagggctggaacgactggcagcaggtcccgttctgcagccaccacttccaccagctgatcatgaaggacggccgggagatcgtggtcccctgccgcaaccaggacgagctggtggggcgggcccgcgtgtcccagggcgccgggtggagcctccgggagaccgcctgcctgggcaagtcctacgcgcagatgtggcagctgatgtacttccaccgccgggacctccgcctggccgccaacgccatctgcagcgcggtccccgtggactgggtgcccacgagccggaccacctggtccatccacgcccaccaccagtggatgaccacggaggacatgctgagcgtctggaaccgcgtgtggatcgaggagaacccgtggatggaggacaagacccacgtgtccagctgggaggaggtcccctacctcgggaagcgcgaggaccagtggtgcggctccctgatcggcctgaccgcccgggccacctgggccacgaacatccaggtggcgatcaaccaggtgcgccggctcatcgggaacgagaactacctggactacatgaccagcatgaagcgcttcaagaacgagtccgaccccgagggcgccctgtggtga

SEQ ID NO: 8091 - RNA, 9879 nt, synthetic construct
  misc_feature 1..9879: note = derived and/or modified CDS sequence (opt1) from DENV-1__GU131981__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcatggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtgttcacctccgtcgggaagctggtgcaccaggtgttcggcaccgcctacggggtcctgttcagcggcgtgtcctggacgatgaagatcgggatcggcatcctcctgacctggctgggcctcaacagccgctccaccagcctgtccatgacctgcatcgccgtggggatggtcacgctgtacctcggcgtgatggtgcaggccgacagcgggtgcgtcatcaactggaagggccgcgagctgaagtgcgggtccggcatcttcgtgaccaacgaggtgcacacctggaccgagcagtacaagttccaggccgacagcccgaagcggctgagcgcggccatcggcaaggcctgggaggagggggtctgcggcatccgctccgccacccggctcgagaacatcatgtggaagcagatcagcaacgagctgaaccacatcctgctcgagaacgacatgaagttcacggtggtggtcggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtcaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggatcctgtgcgccagcatcatgatcgaggaggtgatgcggtcccgctggagccggaagatgctcatgacgggcaccctggccgtgttcctgctcctggtcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggatcaccctgctcagcctgaccttcatcaagaccacgctgtccctcgactacgcctggaagaccaccgccatggcgctgagcatcgtctccctgttccccctctgcctgagcaccacgtcccagaagaccacctggctgccggtgctcctgggcagcttcgggtgcaagcccctgaccatgttcctcatcaccgagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcacgagccacaacatcctggtggaggtgcaggacgacgggaccatgaagatcaaggacgaggagcgcgacgacaccctcaccatcctgctgaaggccacgctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacaccatgtggcacgtgacgcgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccatgcccggcaccttcaagacgcccgagggcgaggtgggggccatcgccctggacttcaagcccggcaccagcgggtccccgatcgtcaaccgggagggcaagatcgtgggcctgtacgggaacggcgtggtcaccaccagcgggacgtacgtgtccgccatcgcccaggcgaaggccagccaggagggccccctccccgagatcgaggacgaggtgttcaagaagcgcaacctgaccatcatggacctgcacccggggagcggcaagacccggcgctacctccccgccatggtccgggaggccatcaagcgcaagctgcggaccctgatcctcgcgcccacgcgcgtggtggcctccgagatggccgaggccctgaagggcatgcccatccgctaccagaccaccgccgtcaagagcgagcacaccgggcgggagatcgtggacctgatgtgccacgcgacgttcaccatgcgcctcctgtccccggtgcgggtccccaactacaacatgatcatcatggacgaggcccacttcaccgaccccgccagcatcgccgcccgcggctacatctccacccgggtggggatgggcgaggcggccgccatcttcatgacggccacgccgcccgggagcgtggaggccttcccccagtccaacgcggtcatccaggacgaggagcgcgacatccccgagcggagctggaactccggctacgactggatcaccgacttccccggcaagaccgtgtggttcgtgcccagcatcaagtccgggaacgacatcgccaactgcctgcgcaagaacggcaagcgggtcatccagctcagccgcaagacgttcgacaccgagtaccagaagaccaagaacaacgactgggactacgtggtgaccacggacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggaccgaggcgaagatgctgctcgacaacatcaacacccccgaggggatcatcccggccctgttcgagcccgagcgcgagaagtccgccgccatcgacggcgagtaccgcctgcgcggggaggcccgcaagacgttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgaccctccgggcgcagaacgccctggacaacctggtgatgctccacaactccgagcagggcgggaaggcctaccgccacgccatggaggagctgcccgacaccatcgagacgctgatgctcctggcgctgatcgccgtgctcaccgggggcgtcaccctgttcttcctgagcgggaagggcctcggcaagacctccatcgggctgctgtgcgtgacggccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcaccgtcgccgccaacgagatggggctgctggagaccacgaagaaggacctcggcatcgggcacgtggcggccgagaaccaccagcacgccaccatgctggacgtggacctgcggccggccagcgcctggaccctctacgcggtcgccaccacggtgatcacccccatgatgcgccacaccatcgagaacaccacggccaacatctccctgaccgccatcgccaaccaggcggccatcctgatgggcctcgacaagggctggcccatcagcaagatggacatcggggtgcccctgctggccctcggctgctactcccaggtcaacccgctgaccctgaccgccgcggtgctcatgctggtggcccactacgccatcatcgggcccggcctgcaggccaaggccacgcgggaggcgcagaagcgcaccgccgccgggatcatgaagaaccccaccgtcgacggcatcgtggccatcgacctcgaccccgtggtctacgacgccaagttcgagaagcagctgggccagatcatgctgctcatcctgtgcaccagccagatcctgctcatgcgcacgacctgggcgctgtgcgagtccatcaccctggccaccgggccgctcacgaccctgtgggagggcagccccgggaagttctggaacaccaccatcgccgtgtccatggccaacatcttccggggcagctacctggccggcgcggggctcgccttctccctgatgaagtccctgggcgggggccgccgggggacgggcgcccagggcgagaccctcggggagaagtggaagcgccagctgaaccagctgtccaagagcgagttcaacacctacaagcggagcggcatcatggaggtggaccgctccgaggccaaggaggggctcaagcggggcgagaccacgaagcacgcggtcagccgcgggaccgccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacaccaagggcggccccgggcacgaggagccgatccccatggccacctacggctggaacctggtcaagctgcacagcgggaaggacgtgttcttcatgccgcccgagaagtgcgacacgctcctgtgcgacatcggcgagtccagcccgaaccccaccatcgaggaggggcgcaccctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacgcacgagatgtactgggtgagctgcggcaccgggaacatcgtgtccgccgtcaacatgaccagccgcatgctcctgaaccggttcaccatggcgcaccgcaagcccacgtacgagcgcgacgtggacctgggcgccggcacccggcacgtggccgtcgagcccgaggtggccaacctcgacatcatcgggcagcgcatcgagaacatcaagaacgagcacaagtccacctggcactacgacgaggacaacccgtacaagacctgggcctaccacggcagctacgaggtgaagccctccgggagcgcgtccagcatggtcaacggcgtggtgcggctgctgacgaagccctgggacgtcatccccatggtgacccagatcgccatgaccgacaccacgccgttcgggcagcagcgcgtcttcaaggagaaggtggacacccggacgccccgggccaagcggggcaccacgcagatcatggaggtgaccgccaagtggctctggggcttcctgtcccgcaacaagaagccccggatctgcacccgcgaggagttcacccggaaggtccgcagcaacgccgcgatcggggccgtgttcgtggacgagaaccagtggaacagcgccaaggaggccgtcgaggacgagcggttctgggacctggtgcaccgcgagcgggagctccacaagcagggcaagtgcgcgacgtgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgcggacgacaccgccgggtgggacacccggatcaccgaggacgacctccagaacgaggccaagatcacggagatcatggagcccgagcacgccctgctggccaccagcatcttcaagctcacctaccagaacaaggtggtgcgcgtccagcgccccgcgaagaacggcaccgtgatggacgtgatctcccggcgcgaccagcgggggagcggccaggtcggcacgtacgggctgaacaccttcaccaacatggaggtgcagctgatccgccagatggagtccgagggcatcttcctccccagcgagctggagaccccgaacctggccgagcgggtgctcgactggctggagaagcacggggccgagcgcctgaagcggatggccatctccggcgacgactgcgtcgtgaagcccatcgacgaccgcttcgccacggcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgctccgcggtgcccgtcgactgggtgcccaccagccgcaccacgtggagcatccacgcccaccaccagtggatgaccaccgaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcacggcccgcgccacctgggccaccaacatccaggtcgcgatcaaccaggtgcggcgcctgatcgggaacgagaactacctggactacatgacctccatgaagcggttcaagaacgagagcgaccccgagggcgccctctggtga

SEQ ID NO: 8092 - RNA, 9879 nt, synthetic construct
  misc_feature 1..9879: note = derived and/or modified CDS sequence (opt1) from DENV-1__GQ868529__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgccggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccttcttcctggcgcacgccatcggcaccagcatcacccagaaggggatcatcttcatcctcctgatgctggtgaccccctccatggccatgcgctgcgtcggcatcggcaaccgggacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcgatcctgcgcaagctctgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcgggctgttcggcaaggggagcctcctgacgtgcgccaagttcaagtgcgtgaccaagctggagggcaagaccgtgcagtacgagaacctcaagtactccgtcatcgtgaccgtgcacacgggcgaccagcaccaggtcgggaacgagaccaccgagcacggcaccatcgcgaccatcacgccccaggcccccaccagcgagatccagctgaccgactacggggccctgaccctcgactgcagcccccggacgggcctggacttcaacgagatggtgctgctcaccatgaaggagaagtcctggctggtccacaagcagtggttcctggacctcccgctgccctggacctccggggccagcaccagccaggagacgtggaaccgccaggacctgctcgtgaccttcaagaccgcccacgcgaagaagcaggaggtggtcgtgctgggctcccaggagggcgccatgcacaccgccctgacgggggccaccgagatccagaccagcggcaccacgaccatcttcgccgggcacctcaagtgccggctgaagatggacaagctgaccctcaagggcacctcctacgtgatgtgcacggggagcttcaagctggagaaggaggtcgcggagacccagcacggcaccgtgctggtgcaggtcaagtacgagggcaccgacgccccctgcaagatccccttctccacgcaggacgagaagggggtgacccagaacggccgcctgatcaccgccaacccgatcgtgaccgacaaggagaagcccgtcaacatcgagacggagccgcccttcggggagagctacatcgtggtgggcgccggcgagaaggcgctcaagctgtcctggttcaagaaggggagctccatcggcaagatgttcgaggccaccgcccgcggggcccgccggatggccatcctgggcgacaccgcgtgggacttcgggagcatcggcggcgtcttcacctccgtggggaagctcgtgcaccaggtcttcggcacggcctacggggtgctgttcagcggcgtgtcctggaccatgaagatcgggatcggcatcctgctcacctggctgggcctgaacagccgctccaccagcctctccatgacgtgcatcgccgtcgggatggtgaccctgtacctgggcgtgatggtccaggccgacagcgggtgcgtgatcaactggaagggccgcgagctcaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacgcggctggagaacatcatgtggaagcagatcagcaacgagctcaaccacatcctgctggagaacgacatgaagttcaccgtggtcgtgggggacgccaacggcatcctcgcgcaggggaagaagatgatccgcccccagcccatggagcacaagtactcctggaagtcctggggcaaggccaagatcatcggcgccgacatccagaacaccaccttcatcatcgacgggcccgacacgccggagtgccccgacaaccagcgggcctggaacatctgggaggtggaggactacggcttcgggatcttcaccaccaacatctggctgaagctgcgcgactcctacacccagatgtgcgaccaccggctcatgagcgcggccatcaaggactccaaggccgtccacgccgacatgggctactggatcgagagcgagaagaacgagacgtggaagctggcccgcgcgtccttcatcgaggtgaagacctgcacctggcccaagagccacaccctgtggtccaacggcgtgctcgagagcgagatgatcatccccaagatctacgggggcccgatctcccagcacaactaccggcccgggtacttcacgcagatcgccggcccctggcacctggggaagctggagctcgacttcgacctgtgcgagggcaccaccgtcgtggtggacgagcactgcggcaaccgcgggccgagcctgcggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctggtgcgcagcatggtctccgccggcagcggcgaggtggacagcttctccctcgggatcctgtgcgccagcatcatgatcgaggaggtgatgcggtcccgctggagccggaagatgctgatgacgggcaccctcgccgtcttcctgctgctcgtgatggggcagctgacctggaacgacctgatccgcctctgcatcatggtgggcgcgaacgcctccgaccgcatggggatgggcaccacgtacctggccctgatggccaccttcaagatgcggccgatgttcgccgtcggcctcctgttccgccggctgaccagccgcgaggtgctcctgctgaccatcgggctctccctggtggcgagcgtcgagctgcccaactccctcgaggagctgggcgacgggctggccatgggcatcatgatgctcaagctgctgacggagttccagccccaccagctctggaccaccctgctgagcctcaccttcatcaagacgaccctgtccctggactacgcctggaagaccaccgccatggcgctcagcatcgtgtccctgttccccctgtgcctcagcacgacctcccagaagaccacctggctgccggtcctgctcggcagcttcgggtgcaagcccctgaccatgttcctgatcacggagaacaagatctggggccggaagtcctggcccctcaacgaggggatcatggccatcggcatcgtgagcatcctgctgtccagcctcctgaagaacgacgtgcccctggccgggccgctcatcgccggcggcatgctgatcgcctgctacgtcatcagcgggtccagcgcggacctgtccctcgagaaggccgccgaggtgagctgggagcaggaggccgagcactccggcaccagccacaacatcctggtggaggtccaggacgacgggaccatgaagatcaaggacgaggagcgcgacgacaccctgacgatcctcctgaaggccaccctgctcgcggtgtccggcgtgtaccccatgagcatccccgccaccctgttcgtctggtacttctggcagaagaagaagcagcggtccggggtgctgtgggacacccccagcccgcccgaggtggagcgcgccgtcctcgacgacggcatctaccggatcctgcagcgcggcctgctggggcggtcccaggtgggcgtgggggtcttccaggacggcgtgttccacacgatgtggcacgtgacccgcggggccgtcctcatgtaccagggcaagcggctggagcccagctgggcctccgtgaagaaggacctgatcagctacggcgggggctggcgcttccaggggtcctggaacaccggcgaggaggtgcaggtcatcgcggtggagcccgggaagaacccgaagaacgtgcagaccacgcccggcaccttcaagacccccgagggcgaggtcggggccatcgccctcgacttcaagcccggcaccagcgggtccccgatcgtgaaccgggagggcaagatcgtgggcctgtacgggaacggcgtcgtgacgaccagcgggacctacgtgtccgccatcgcccaggcgaaggccagccaggagggccccctgcccgagatcgaggacgaggtcttcaagaagcgcaacctcaccatcatggacctgcacccggggagcggcaagacgcggcgctacctgcccgccatggtgcgggaggccatcaagcgcaagctccggaccctgatcctggcgcccacccgcgtggtcgcctccgagatggccgaggccctcaagggcatgcccatccgctaccagaccacggccgtcaagagcgagcacaccgggcgggagatcgtggacctgatgtgccacgcgaccttcaccatgcgcctgctctccccggtccgggtgcccaactacaacatgatcatcatggacgaggcccacttcacggaccccgccagcatcgccgcccgcggctacatctccacccgggtggggatgggcgaggcggccgccatcttcatgaccgccacgccgcccgggagcgtcgaggccttcccccagtccaacgcggtgatccaggacgaggagcgcgacatccccgagcggagctggaactccggctacgactggatcacggacttccccggcaagaccgtgtggttcgtccccagcatcaagtccgggaacgacatcgccaactgcctgcgcaagaacggcaagcgggtgatccagctgagccgcaagaccttcgacaccgagtaccagaagacgaagaacaacgactgggactacgtggtcaccaccgacatctccgagatgggggccaacttccgggccgaccgcgtgatcgacccccggcgctgcctcaagcccgtgatcctgaaggacggccccgagcgggtcatcctggcggggccgatgcccgtgaccgtggccagcgccgcccagcgccggggccgcatcggccggaaccagaacaaggagggggaccagtacgtctacatgggccagcccctcaacaacgacgaggaccacgcccactggacggaggcgaagatgctgctggacaacatcaacacccccgaggggatcatcccggccctcttcgagcccgagcgcgagaagtccgccgccatcgacggcgagtaccgcctgcgcggggaggcccgcaagaccttcgtggagctgatgcggcgcggcgacctccccgtctggctgagctacaaggtggcgtccgagggcttccagtacagcgaccggcgctggtgcttcgacggggagcggaacaaccaggtgctggaggagaacatggacgtcgagatctggaccaaggagggcgagcgcaagaagctccggccccgctggctggacgcccggacctactccgacccgctggccctccgcgagttcaaggagttcgccgccgggcggcgcagcgtgagcggcgacctgatgctggagatcggcaagctcccccagcacctgacgctgcgggcgcagaacgccctcgacaacctggtgatgctgcacaactccgagcagggcgggaaggcctaccgccacgccatggaggagctccccgacaccatcgagaccctgatgctgctcgcgctgatcgccgtcctgaccgggggcgtgaccctcttcttcctgagcgggaagggcctgggcaagacctccatcgggctcctgtgcgtgaccgccagctccgccctgctctggatggccagcgtcgagccccactggatcgcggcctccatcatcctggagttcttcctgatggtgctcctgatcccggagcccgaccggcagcgcacgccccaggacaaccagctggcctacgtggtcatcggcctcctgttcatgatcctgacggtggccgccaacgagatggggctcctggagaccaccaagaaggacctgggcatcgggcacgtggcggccgagaaccaccagcacgccaccatgctcgacgtcgacctgcggccggccagcgcctggacgctgtacgcggtggccaccaccgtgatcacccccatgatgcgccacacgatcgagaacaccaccgccaacatctccctcaccgccatcgccaaccaggcggccatcctgatgggcctggacaagggctggcccatcagcaagatggacatcggggtccccctcctggccctgggctgctactcccaggtgaacccgctcacgctgaccgccgcggtgctgatgctcgtcgcccactacgccatcatcgggcccggcctgcaggccaaggccacccgggaggcgcagaagcgcaccgccgccgggatcatgaagaaccccacggtggacggcatcgtggccatcgacctggaccccgtcgtgtacgacgccaagttcgagaagcagctcggccagatcatgctgctgatcctctgcaccagccagatcctgctgatgcgcaccacctgggcgctctgcgagtccatcacgctggccaccgggccgctgaccaccctctgggagggcagccccgggaagttctggaacacgaccatcgccgtgtccatggccaacatcttccggggcagctacctggccggcgcggggctggccttctccctcatgaagtccctgggcgggggccgccgggggaccggcgcccagggcgagaccctgggggagaagtggaagcgccagctcaaccagctgtccaagagcgagttcaacacgtacaagcggagcggcatcatggaggtcgaccgctccgaggccaaggaggggctgaagcggggcgagaccaccaagcacgcggtgagccgcgggaccgccaagctccggtggttcgtggagcgcaacctggtcaagcccgagggcaaggtgatcgacctgggctgcgggcggggcgggtggtcctactactgcgccggcctgaagaaggtgaccgaggtcaaggggtacacgaagggcggcctcgggcacgaggaccccatcccgatggccacctacggctggaacctggtgaagctgctcgccgggaaggacgtgttcttcatgccgcccgagaagtgcgacaccctgctgtgcgacatcggcgagagctcccccaacccgaccatcgaggaggggcgcacgctccgggtcctgaagatggtggagccctggctgcgcggcaaccagttctgcatcaagatcctcaacccctacatgcccagcgtggtcgagaccctggagcagatgcagcggaagcacggcgggatgctggtgcgcaacccgctctcccggaacagcacccacgagatgtactgggtgtcctgcggcaccgggaacatcgtcagcgcggtgaacatgacgtcccgcatgctgctgaaccggttcaccatggcccaccgcaagcccacctacgagcgcgacgtggacctcggcgccggcacccggcacgtcgccgtggagcccgaggtggccaacctggacatcatcgggcagcgcatcgagaacatcaagaacgagcacaagagcacgtggcactacgacgaggacaacccctacaagacctgggcgtaccacggctcctacgaggtcaagccgagcgggtccgccagctccatggtgaacggcgtggtccggctgctcaccaagccctgggacgtgatccccatggtcacccagatcgccatgacggacaccacccccttcgggcagcagcgcgtgttcaaggagaaggtggacacccggacgccgcgcgccaagcggggcaccacccagatcatggaggtcaccgccaagtggctgtggggcttcctgagccgcaacaagaagccccggatctgcacgcgcgaggagttcacccggaaggtgcgctccaacgcggccatcggggccgtgttcgtcgacgagaaccagtggaacagcgccaaggaggcggtggaggacgagcggttctgggacctcgtgcaccgcgagcgggagctgcacaagcagggcaagtgcgcgacctgcgtctacaacatgatggggaagcgcgagaagaagctgggcgagttcgggaaggccaagggcagccgggccatctggtacatgtggctcggcgcccgcttcctggagttcgaggcgctggggttcatgaacgaggaccactggttctcccgggagaacagcctctccggcgtggagggggagggcctgcacaagctggggtacatcctccgcgacatcagcaagatccccggcggcaacatgtacgccgacgacaccgccgggtgggacacgcggatcaccgaggacgacctgcagaacgaggccaagatcaccgagatcatggagccggagcacgccctgctcgcgacctccatcttcaagctgacgtaccagaacaaggtggtccgcgtgcagcgccccgccaagaacggcaccgtgatggacgtcatcagccggcgcgaccagcgggggtccggccaggtgggcacctacgggctgaacaccttcacgaacatggaggtgcagctcatccgccagatggagagcgagggcatcttcctgccctccgagctggagacccccaacctcgccgagcgggtcctggactggctggagaagcacggggccgagcgcctcaagcggatggccatcagcggcgacgactgcgtggtgaagccgatcgacgaccgcttcgcgaccgccctgaccgccctgaacgacatggggaaggtccggaaggacatcccccagtgggagccctccaagggctggaacgactggcagcaggtccccttctgcagccaccacttccaccagctcatcatgaaggacggccgcgagatcgtggtcccgtgccggaaccaggacgagctggtggggcgcgcccgggtgtcccagggcgccgggtggagcctgcgcgagaccgcgtgcctcggcaagtcctacgcccagatgtggcagctgatgtacttccaccggcgcgacctgcggctcgccgccaacgcgatctgcagcgccgtccccgtggactgggtgcccacgtcccgcaccacctggagcatccacgcccaccaccagtggatgaccacggaggacatgctgagcgtctggaaccgggtgtggatcgaggagaacccctggatggaggacaagacccacgtgtccagctgggaggaggtcccgtacctggggaagcgcgaggaccagtggtgcggctccctcatcggcctgaccgcccgcgccacctgggcgacgaacatccaggtggccatcaaccaggtgcggcgcctgatcgggaacgagaactacctcgactacatgaccagcatgaagcggttcaagaacgagtccgaccccgagggcgccctgtggtga

SEQ ID NO: 8093 - RNA, 9879 nt, synthetic construct
  misc_feature 1..9879: note = derived and/or modified CDS sequence (opt1) from DENV-1__GQ868531__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgtgagcatcatgatcgaggaggtcatgcggtcccgctggagccggaagatgctcatgacgggcaccctggccgtgttcctgctcctggtgatggggcagctgacctggaacgacctcatccgcctgtgcatcatggtcggcgccaacgcgtccgaccgcatggggatgggcaccacgtacctggccctcatggccaccttcaagatgcggccgatgttcgccgtggggctgctgttccgccggctcaccagccgcgaggtgctgctgctcaccatcgggctgtccctggtcgccagcgtggagctccccaactccctggaggagctgggcgacgggctcgcgatgggcatcatgatgctgaagctgctcacggagttccagccccaccagctgtggaccaccctgctcagcctgaccttcatcaagacgaccctgtccctcgactacgcctggaagaccaccgccatggccctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggccgtgtccggcgtctaccccatgagcatccccgcgaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcaccagcgggtccccgatcgtgaaccgggagggcaagatcgtcggcctgtacgggaacggcgtggtgacgaccagcgggacctacgtctccgccatcgcccaggccaaggcgagccaggagggccccctccccgagatcgaggacgaggtgttcaagaagcgcaacctgaccatcatggacctgcacccggggagcggcaagacgcggcgctacctccccgccatcgtgcgggaggccatcaagcgcaagctgcggaccctgatcctcgcccccacccgcgtcgtggcgtccgagatggccgaggccctgaagggcatgcccatccgctaccagaccacggccgtcaagagcgagcacaccgggcgggagatcgtcgacctgatgtgccacgccaccttcaccatgcgcctcctgtccccggtgcgggtgcccaactacaacatgatcatcatggacgaggcgcacttcacggaccccgccagcatcgccgcccgcggctacatctccacccgggtcgggatgggcgaggccgcggccatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgcgaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgccgggccgatgcccgtgaccgtcgcgagcgccgcccagcgccggggccgcatcggccggaaccagaacaaggagggggaccagtacgtgtacatgggccagcccctgaacaacgacgaggaccacgcccactggacggaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtggcctccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcgcggacctactccgacccgctcgccctgcgcgagttcaaggagttcgccgccgggcggcgcagcgtgagcggcgacctgatcctcgagatcggcaagctgccccagcacctgacgctccgggcccagaacgcgctggacaacctggtcatgctccacaactccgagcagggcgggaaggcctaccgccacgccatggaggagctgcccgacaccatcgagaccctgatgctcctggccctgatcgcggtgctcaccgggggcgtgacgctgttcttcctgagcgggaagggcctcggcaagacctccatcgggctgctgtgcgtcaccgccagctccgccctcctgtggatggccagcgtggagccccactggatcgccgcgtccatcatcctggagttcttcctcatggtgctgctgatcccggagcccgaccggcagcgcacgccccaggacaaccagctcgcctacgtcgtgatcggcctgctgttcatgatcctcacggtggccgccaacgagatggggctgctggagaccaccaagaaggacctcggcatcgggcacgtcgccgcggagaaccaccagcacgccaccatgctggacgtggacctgcggccggccagcgcctggacgctctacgccgtggcgaccaccgtcatcacccccatgatgcgccacacgatcgagaacaccaccgccaacatctccctgaccgccatcgccaaccaggccgcgatcctgatgggcctcgacaagggctggcccatcagcaagatggacatcggggtgcccctgctggccctcggctgctactcccaggtgaacccgctgacgctgaccgccgccgtcctcatgctggtggcgcactacgccatcatcgggcccggcctgcaggccaaggccacccgggaggcccagaagcgcaccgcggccgggatcatgaagaaccccacggtggacggcatcgtcgccatcgacctcgaccccgtggtgtacgacgccaagttcgagaagcagctgggccagatcatgctgctcatcctgtgcaccagccagatcctgctcatgcgcaccacctgggccctgtgcgagtccatcacgctggcgaccgggccgctcaccaccctgtgggagggcagccccgggaagttctggaacacgaccatcgccgtctccatggccaacatcttccggggcagctacctggccggcgccgggctcgcgttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgccgtgagccgcgggaccgcgaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacacgaagggcggccccgggcacgaggagccgatccccatggccacctacggctggaacctggtgaagctgcacagcgggaaggacgtcttcttcatgccgcccgagaagtgcgacaccctcctgtgcgacatcggcgagtccagcccgaaccccaccatcgaggaggggcgcacgctgcgggtgctcaagatggtggagccctggctgcgcggcaaccagttctgcatcaagatcctgaacccctacatgccgtccgtcgtggaggccctcgagcagatgcagcggaagcacggcgggatgctggtgcgcaaccccctgagccggaactccacccacgagatgtactgggtcagctgcggcaccgggaacatcgtgtccgccgtgaacatgaccagccgcatgctcctgaaccggttcacgatggcgcaccgcaagcccacctacgagcgcgacgtcgacctgggcgccggcacccggcacgtggccgtggagcccgaggtcgccaacctcgacatcatcgggcagcgcatcgagaacatcaagaacgagcacaagtccacctggcactacgacgaggacaacccgtacaagacgtgggcctaccacggcagctacgaggtgaagccctccgggagcgcgtccagcatggtgaacggcgtcgtgcggctgctgaccaagccctgggacgtcatccccatggtgacccagatcgccatgaccgacacgaccccgttcgggcagcagcgcgtgttcaaggagaaggtcgacacccggacgccccgggccaagcggggcacgacccagatcatggaggtgaccgccaagtggctctggggcttcctgtcccgcaacaagaagccccggatctgcacccgcgaggagttcacgcggaaggtgcgcagcaacgccgcgatcggggccgtcttcgtggacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacaccgccgggtgggacacccggatcacggaggacgacctccagaacgaggccaagatcaccgagatcatggagcccgagcacgccctgctggccaccagcatcttcaagctcacctaccagaacaaggtcgtgcgcgtgcagcgccccgcgaagaacggcacggtcatggacgtgatctcccggcgcgaccagcgggggagcggccaggtgggcacctacgggctgaacaccttcaccaacatggaggtccagctgatccgccagatggagtccgagggcatcttcctccccagcgagctggagacgccgaacctggccgagcgggtgctcgactggctggagaagcacggggccgagcgcctgaagcggatggccatctccggcgacgactgcgtggtcaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctcgtggggcgcgcccgggtcagccagggcgccgggtggtccctgcgcgagaccgcctgcctgggcaagagctacgcgcagatgtggcagctcatgtacttccaccggcgcgacctgcggctggccgccaacgccatctccagcgcggtgcccgtggactgggtccccaccagccgcacgacctggtccatccacgcccaccaccagtggatgaccaccgaggacatgctcagcgtgtggaaccgggtgtggatcgaggagaacccgtggatggaggacaagacgcacgtctccagctgggaggaggtgccctacctggggaagcgcgaggaccagtggtgcggctccctgatcggcctcaccgcccgcgccacctgggccaccaacatccaggtggcgatcaaccaggtccggcgcctgatcgggaacgagaactacctggactacatgacgagcatgaagcggttcaagaacgagtccgaccccgagggcgccctctggtga

SEQ ID NO: 8094 - RNA, 9879 nt, synthetic construct
  misc_feature 1..9879: note = derived and/or modified CDS sequence (opt1) from DENV-1__GU131983__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggggagctctgcgaggacaccatgacctacaagtgcccccagatcaccgaggccgagcccgacgacgtggactgctggtgcaacgccaccgacacctgggtgacctacgggacctgcagccagaccggggagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgatcggcacgctggccgtcttcctgctcctggtgatggggcagctgacctggaacgacctcatccgcctgtgcatcatggtgggcgcgaacgcctccgaccgcatggggatgggcaccacctacctggccctcatggccacgttcaagatgcggccgatgttcgccgtcggcctgctgttccgccggctcaccagccgcgaggtgctgctgctcaccatcgggctgtccctggtggcgagcgtcgagctccccaactccctggaggagctgggcgacgggctcgccatgggcatcatgatgctgaagctgctcaccgagttccagccccaccagctgtggacgaccctgctcagcctgaccttcatcaagaccacgctgtccctcgactacgcctggaagaccaccgccatggcgctgagcatcgtgtccctgttccccctctgcctgagcaccacgtcccagaagaccacctggctgccggtcctcctgggcagcttcgggtgcaagcccctgaccatgttcctcatcaccgagaacaagatctggggccggaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggtccagcgcggacctctccctggagaaggccgccgaggtgagctgggagcaggaggccgagcactccggcacgagccacaacatcctggtggaggtccaggacgacgggaccatgaagatcaaggacgaggagcgcgacgacaccctcaccatcctgctgaaggccacgctcctggcggtgtccggcgtgtaccccatgagcatccccgccaccctgttcgtctggtacttctggcagaagaagaagcagcggtccggggtgctctgggacacccccagcccgcccgaggtggagcgcgccgtcctggacgacggcatctaccggatcctgcagcgcggcctgctcgggcggtcccaggtgggcgtgggggtcttccaggacggcgtgttccacaccatgtggcacgtgacgcgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgcggtggagcccgggaagaacccgaagaacgtgcagaccacccccggcacgttcaagacccccgagggcgaggtcggggccatcgccctggacttcaagcccggcaccagcgggtccccgatcgtgaaccgggagggcaagatcgtgggcctgtacgggaacggcgtcgtgaccacgagcgggacctacgtgtccgccatcgcccaggcgaaggccagccaggagggccccctccccgagatcgaggacgaggtcttcaagaagcgcaacctgaccatcatggacctgcacccggggagcggcaagacccggcgctacctccccgccatcgtgcgggaggccatcaagcgcaagctgcggacgctgatcctcgcgcccacccgcgtggtcgcctccgagatggccgaggccctgaagggcatgcccatccgctaccagaccaccgccgtcaagagcgagcacacggggcgggagatcgtggacctgatgtgccacgcgaccttcaccatgcgcctcctgtccccggtccgggtgcccaactacaacatgatcatcatggacgaggcccacttcaccgaccccgccagcatcgccgcccgcggctacatctccacgcgggtggggatgggcgaggcggccgccatcttcatgaccgccacgccgcccgggagcgtcgaggccttcccccagtccaacgcggtgatccaggacgaggagcgcgacatccccgagcggagctggaactccggctacgactggatcaccgacttccccggcaagacggtgtggttcgtccccagcatcaagtccgggaacgacatcgccaactgcctgcgcaagaacggcaagcgggtgatccagctcagccgcaagaccttcgacaccgagtaccagaagaccaagaacaacgactgggactacgtggtcacgaccgacatctccgagatgggggccaacttccgggccgaccgcgtgatcgacccccggcgctgcctgaagcccgtgatcctgaaggacggccccgagcgggtcatcctcgcggggccgatgcccgtgaccgtggccagcgccgcccagcgccggggccgcatcggccggaaccagaacaaggagggggaccagtacgtctacatgggccagcccctgaacaacgacgaggaccacgcccactggaccgaggcgaagatgctgctcgacaacatcaacacgcccgaggggatcatcccggccctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcgtccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgaccctccgggcgcagaacgccctggacaacctggtgatgctccacaactccgagcagggcgggaaggcctaccgccacgccatggaggagctgcccgacacgatcgagaccctgatgctcctggcgctgatcgccgtcctcaccgggggcgtgaccctgttcttcctgagcgggaagggcctcggcaagacgtccatcgggctgctgtgcgtgaccgccagctccgccctcctgtggatggccagcgtcgagccccactggatcgcggcctccatcatcctggagttcttcctcatggtgctgctgatcccggagcccgaccggcagcgcacgccccaggacaaccagctcgcctacgtggtcatcggcctgctgttcatgatcctcaccgtggccgccaacgagatggggctgctggagacgaccaagaaggacctcggcatcgggcacgtggcggccgagaaccaccagcacgccaccatgctggacgtcgacctgcggccggccagcgcctggaccctctacgcggtggccacgaccgtgatcacccccatgatgcgccacaccatcgagaacacgaccgccaacatctccctgaccgccatcgccaaccaggcggccatcctgatgggcctcgacaagggctggcccatcagcaagatggacatcggggtccccctgctggccctcggctgctactcccaggtgaacccgctgaccctgacggccgcggtgctcatgctggtcgcccactacgccatcatcgggcccggcctgcaggccaaggccacccgggaggcgcagaagcgcaccgccgccgggatcatgaagaaccccaccgtggacggcatcgtggccatcgacctcgaccccgtcgtgtacgacgccaagttcgagaagcagctgggccagatcatgctgctcatcctgtgcacgagccagatcctgctcatgcgcaccacctgggcgctgtgcgagtccatcaccctggccacggggccgctcaccaccctgtgggagggcagccccgggaagttctggaacaccacgatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacctacaagcggagcggcatcatggaggtcgaccgctccgaggccaaggaggggctcaagcggggcgagacgaccaagcacgcggtgagccgcgggaccgccaagctgcggtggttcgtggagcgcaacctggtcaagcccgagggcaaggtgatcgacctgggctgcgggcggggcgggtggtcctactactgcgccggcctcaagaaggtgaccgaggtcaaggggtacaccaagggcggccccgggcacgaggagccgatccccatggccacgtacggctggaacctggtgaagctgcacagcgggaaggacgtgttcttcatgccgcccgagaagtgcgacaccctcctgtgcgacatcggcgagtccagcccgaaccccaccatcgaggaggggcgcaccctgcgggtcctcaagatggtggagccctggctgcgcggcaaccagttctgcatcaagatcctgaacccctacatgccgtccgtggtcgagacgctcgagcagatgcagcggaagcacggcgggatgctggtgcgcaaccccctgagccggaactccacccacgagatgtactgggtgagctgcggcaccgggaacatcgtctccgccgtgaacatgaccagccgcatgctcctgaaccggttcacgatggcgcaccgcaagcccacctacgagcgcgacgtggacctgggcgccggcacccggcacgtcgccgtggagcccgaggtggccaacctcgacatcatcgggcagcgcatcgagaacatcaagaacgagcacaagtccacctggcactacgacgaggacaacccgtacaagacgtgggcctaccacggcagctacgaggtcaagccctccgggagcgcgtccagcatggtgaacggcgtggtccggctgctgaccaagccctgggacgtgatccccatggtcacccagatcgccatgaccgacacgaccccgttcgggcagcagcgcgtgttcaaggagaaggtggacacccggacgccccgggccaagcggggcacgacccagatcatggaggtcaccgccaagtggctctggggcttcctgtcccgcaacaagaagccccggatctgcacccgcgaggagttcacgcggaaggtgcgcagcaacgccgcgatcggggccgtgttcgtcgacgagaaccagtggaacagcgccaaggaggccgtggaggacgagcggttctgggacctggtgcaccgcgagcgggagctccacaagcagggcaagtgcgcgacctgcgtctacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacaccgccgggtgggacacccggatcacggaggacgacctccagaacgaggccaagatcaccgagatcatggagcccgagcacgccctgctggccaccagcatcttcaagctcacctaccagaacaaggtggtccgcgtgcagcgccccgcgaagaacggcacggtgatggacgtcatctcccggcgcgaccagcgggggagcggccaggtgggcacctacgggctgaacaccttcaccaacatggaggtgcagctgatccgccagatggagtccgaggagatcttcctccccagcgagctggagacgccgaacctggccgagcgggtcctcgactggctggagaagcacggcgccgagcgcctgaagcggatggccatctccggggacgactgcgtggtgaagcccatcgacgaccgcttcgccaccgcgctcaccgccctgaacgacatgggcaaggtccggaaggacatcccccagtgggagcccagcaaggggtggaacgactggcagcaggtcccgttctgctcccaccacttccaccagctgatcatgaaggacggccgcgagatcgtggtcccctgccggaaccaggacgagctcgtgggccgcgcccgggtgagccagggggccggctggtccctgcgcgagaccgcctgcctgggcaagagctacgcgcagatgtggcagctcatgtacttccaccggcgcgacctgcggctggccgccaacgccatctgctccgcggtccccgtggactgggtgcccaccagccgcacgacctggagcatccacgcccaccaccagtggatgaccaccgaggacatgctctccgtctggaaccgggtgtggatcgaggagaacccgtggatggaggacaagacgcacgtgagctcctgggaggaggtcccctacctgggcaagcgcgaggaccagtggtgcgggagcctgatcggcctcaccgcccgcgccacctgggccaccaacatccaggtggcgatcaaccaggtgcggcgcctgatcggcaacgagaactacctggactacatgacgtccatgaagcggttcaagaacgagagcgaccccgagggggccctctggtga

SEQ ID NO: 8095 - RNA, 9879 nt, synthetic construct
  misc_feature 1..9879: note = derived and/or modified CDS sequence (opt1) from DENV-1__GQ868532__SS-prME
  source 1..9879: mol_type = other RNA
agcgtgaccatgctgctcatgctgctgcccaccgccctcgccttccacctgaccacccggggcggggagccgcacatgatcgtcagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacgtgggtcacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctggtgatggggcagctgacctggaacgacctcatccgcctgtgcatcatggtgggcgcgaacgcctccgaccgcatggggatgggcaccacgtacctggccctcatggccaccttcaagatgcggccgatgttcgccgtcgggctgctgttccgccggctcaccagccgcgaggtgctgctgctcaccatcgggctgtccctggtggcgagcgtcgagctccccaactccctggaggagctgggcgacgggctcgccatgggcatcatgatgctgaagctgctcacggagttccagccccaccagctgtggatcaccctgctcagcctgaccttcatcaagaccacgctgtccctcgactacgcctggaagaccaccgccatggcgctgagcatcgtgtccctgttccccctctgcctgagcaccacgtcccagaagaccacctggctgccggtcctcctgggcagcttcgggtgcaagcccctgaccatgttcctcatcaccgagaacaagatctggggccggaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggaactccgcggacctcagcctggagaaggccgccgaggtgtcctgggagcaggaggccgagcacagcggcacgtcccacaacatcctggtggaggtccaggacgacgggaccatgaagatcaaggacgaggagcgcgacgacaccctcaccatcctgctgaaggccacgctcctggcggtgagcggcgtgtaccccatgtccatccccgccaccctgttcgtctggtacttctggcagaagaagaagcagcggagcggggtgctctgggacaccccctccccgcccgaggtggagcgcgccgtcctggacgacggcatctaccggatcctgcagcgcggcctgctcgggcggagccaggtgggcgtgggggtcttccaggacggcgtgttccacaccatgtggcacgtgacgcgcggggccgtcctgatgtaccagggcaagcggctggagccctcctgggccagcgtgaagaaggacctcatctcctacggcgggggctggcgcttccaggggagctggaacaccggcgaggaggtgcaggtcatcgcggtggagcccgggaagaacccgaagaacgtgcagaccatgcccggcaccttcaagacgcccgagggcgaggtcggggccatcgccctggacttcaagcccggcacctccgggagcccgatcgtgaaccgggagggcaagatcgtgggcctgtacgggaacggcgtcgtgaccacctccgggacgtacgtgagcgccatcgcccaggcgaaggcctcccaggaggggccgccgcccgagatcgaggacgaggtcttcaagaagcgcaacctcaccatcatggacctgcaccccgggagcggcaagacccggcgctacctgcccgccatggtgcgggaggccatcaagcgcaagctccggaccctgatcctggcgcccacgcgcgtggtcgccagcgagatggccgaggccctcaagggcatgcccatccgctaccagaccaccgccgtgaagtccgagcacaccgggcgggagatcgtggacctgatgtgccacgcgacgttcaccatgcgcctgctcagccccgtccgggtgcccaactacaacatgatcatcatggacgaggcccacttcaccgaccccgcctccatcgccgcccgcggctacatcagcacccgggtggggatgggcgaggcggccgccatcttcatgacggccaccccgcccgggtccgtcgaggccttcccccagagcaacgcggtgatccaggacgaggagcgcgacatccccgagcggtcctggaacagcggctacgactggatcaccgacttcccgggcaagaccgtgtggttcgtcccctccatcaagagcgggaacgacatcgccaactgcctgcgcaagaacggcaagcgggtgatccagctgtcccgcaagacgttcgacaccgagtaccagaagaccaagaacaacgactgggactacgtggtcaccacggacatcagcgagatgggggccaacttccgggccgaccgcgtgatcgacccccggcgctgcctcaagcccgtgatcctgaaggacggcccggagcgggtcatcctggcggggcccatgcccgtgaccgtggcctccgccgcccagcgccggggccgcatcggccggaaccagaacaaggagggggaccagtacgtctacatgggccagcccctcaacaacgacgaggaccacgcccactggaccgaggcgaagatgctgctggacaacatcaacaccccggaggggatcatccccgccctcttcgagcccgagcgcgagaagtccgccgccatcgacggcgagtaccgcctgcgcggggaggcccgcaagacgttcgtggagctgatgcggcgcggcgacctccccgtctggctgtcctacaaggtggcgagcgagggcttccagtactccgaccggcgctggtgcttcgacggggagcggaacaaccaggtgctggaggagaacatggacgtcgagatctggaccaaggagggcgagcgcaagaagctccggccgcgctggctggacgcccggacctacagcgaccccctggccctccgcgagttcaaggagttcgccgccgggcggcgctccgtgagcggcgacctgatcctggagatcggcaagctcccccagcacctgaccctgcgggcgcagaacgccctcgacaacctggtgatgctgcacaacagcgagcagggcgggaaggcctaccgccacgccatggaggagctccccgacaccatcgagacgctgatgctgctcaccctgatcgcggtcctgaccgggggcgtgaccctcttcttcctgtccgggaagggcctgggcaagacgagcatcgggctcctgtgcgtgaccgcctccagcgccctgctctggatggcctccgtcgagccgcactggatcgccgcgagcatcatcctggagttcttcctgatggtgctcctgatccccgagcccgaccggcagcgcaccccgcaggacaaccagctggcctacgtggtcatcggcctcctgttcatgatcctgaccgtggccgccaacgagatggggctcctggagacgaccaagaaggacctgggcatcgggcacgtggccgcggagaaccaccagcacgccaccatgctcgacgtcgacctgcggcccgcctccgcctggaccctgtacgccgtggcgacgaccgtgatcacccccatgatgcgccacaccatcgagaacacgaccgccaacatcagcctcaccgccatcgccaaccaggccgcgatcctgatgggcctggacaagggctggcccatctccaagatggacatcggggtcccgctcctggccctgggctgctacagccaggtgaaccccctcaccctgacggccgccgtgctgatgctcgtcgcgcactacgccatcatcgggcccggcctgcaggccaaggccacccgggaggcccagaagcgcaccgcggccgggatcatgaagaaccccaccgtggacggcatcgtggccatcgacctggacccggtcgtgtacgacgccaagttcgagaagcagctcggccagatcatgctgctgatcctctgcacgtcccagatcctgctgatgcgcaccacctgggccctctgcgagagcatcaccctggcgacggggcccctgaccaccctctgggagggctcccccgggaagttctggaacaccacgatcgccgtgagcatggccaacatcttccggggctcctacctggccggcgccgggctggcgttcagcctcatgaagtccctgggcgggggccgccgggggaccggcgcccagggcgagaccctgggggagaagtggaagcgccagctcaaccagctgagcaagtccgagttcaacacctacaagcggagcggcatcatggaggtcgaccgcagcgaggccaaggaggggctgaagcggggcgagacgaccaagcacgccgtgtcccgcgggaccgcgaagctccggtggttcgtggagcgcaacctggtcaagcccgagggcaaggtgatcgacctgggctgcgggcggggcgggtggagctactactgcgccggcctgaagaaggtgaccgaggtcaaggggtacaccaagggcggcccggggcacgaggagcccatccccatggccacgtacggctggaacctcgtgaagctgcactccgggaaggacgtgttcttcatgcccccggagaagtgcgacaccctgctctgcgacatcggcgagagctcccccaaccccaccatcgaggaggggcgcaccctgcgggtcctgaagatggtggagccctggctccgcggcaaccagttctgcatcaagatcctgaacccgtacatgcccaacgtggtcgagacgctggagcagatgcagcggaagcacggcgggatgctcgtgcgcaaccccctgagccggaactccacccacgagatgtactgggtgagctgcggcaccgggaacatcgtctccgccgtgaacatgaccagccgcatgctgctcaaccggttcacgatggcccaccgcaagcccacctacgagcgcgacgtggacctgggcgcgggcacccggcacgtcgccgtggagccggaggtggccaacctggacatcatcgggcagcgcatcgagaacatcaagaacgagcacaagtccacctggcactacgacgaggacaacccctacaagacgtgggcctaccacggcagctacgaggtcaagccctccgggagcgcctccagcatggtgaacggcgtggtccggctcctgaccaagccctgggacgggatcccgatggtgacccagatcgcgatgaccgacacgacccccttcggccagcagcgcgtcttcaaggagaaggtggacacccggacgccccgggccaagcggggcacgacccagatcatggaggtgaccgccaagtggctgtgggggttcctctcccgcaacaagaagccgcggatctgcacccgcgaggagttcacgcggaaggtccgcagcaacgccgccatcggcgcggtgttcgtggacgagaaccagtggaactccgccaaggaggccgtcgaggacgagcggttctgggacctggtgcaccgcgagcgggagctgcacaagcaggggaagtgcgcgacctgcgtgtacaacatgatgggcaagcgcgagaagaagctcggggagttcggcaaggcgaagggcagccgggccatctggtacatgtggctgggggcccgcttcctggagttcgaggccctcggcttcatgaacgaggaccactggttcagccgggagaactccctgagcggggtcgagggcgaggggctgcacaagctcggctacatcctgcgcgacatctccaagatccccggcgggaacatgtacgccgacgacaccgcgggctgggacacccggatcacggaggacgacctgcagaacgaggccaagatcaccgagatcatggagcccgagcacgccctcctggccaccagcatcttcaagctgacctaccagaacaaggtggtgcgcgtccagcgccccgccaagaacgggacggtgatggacgtgatctcccggcgcgaccagcggggcagcggccaggtcgggacctacggcctcaacaccttcaccaacatggaggtgcagctgatccgccagatggagtccgaggggatcttcctgccgagcgagctcgagacgcccaacctggcggagcgggtgctggactggctcgagaagcacggcgccgagcgcctgaagcggatggccatctccggggacgactgcgtcgtgaagcccatcgacgaccgcttcgccaccgccctgaccgcgctcaacgacatgggcaaggtgcggaaggacatcccccagtgggagccgagcaagggctggaacgactggcagcaggtccccttctgctcccaccacttccaccagctgatcatgaaggacgggcgcgagatcgtggtgccctgccggaaccaggacgagctggtcggccgcgcccgggtgagccagggggccggctggtccctccgcgagaccgcctgcctgggcaagagctacgcccagatgtggcagctgatgtacttccaccggcgcgacctccggctggcggccaacgccatctgctccgccgtgcccgtcgactgggtgccgaccagccgcacgacctggtccatccacgcgcaccaccagtggatgaccaccgaggacatgctgagcgtgtggaaccgggtctggatcgaggagaacccctggatggaggacaagacgcacgtgagctcctgggaggaggtgccctacctcggcaagcgcgaggaccagtggtgcggcagcctgatcgggctgaccgcccgcgccacctgggccaccaacatccaggtcgccatcaaccaggtgcggcgcctcatcggcaacgagaactacctggactacatgacgtccatgaagcggttcaagaacgagagcgaccccgagggggcgctgtggtga

SEQ ID NO: 8096 - RNA, 9879 nt, synthetic construct
  misc_feature 1..9879: note = derived and/or modified CDS sequence (opt1) from DENV-1__GQ868533__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctgctgttcaagacctccgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtggagacctgggccctgcggcaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcgaggccgacatccagaacaccaccttcatcatcgacggccccgacaccccggagtgccccgacaaccagcgggcctggaacatctgggaggtggaggactacgggttcggcatcttcacgaccaacatctggctgaagctccgcgactcctacacccagatgtgcgaccaccggctgatgagcgcggccatcaaggactccaaggccgtccacgccgacatggggtactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacggcgggccgatctcccagcacaactaccggcccggctacttcacccagacggccgggccctggcacctgggcaagctcgagctggacttcgacctgtgcgaggggaccaccgtcgtggtggacgagcactgcggcaaccgcggcccgagcctccggaccacgaccgtcaccgggaagatcatccacgagtggtgctgccgctcctgcaccctgccgcccctgcggttccgcggcgaggacgggtgctggtacggcatggagatccggcccgtgaaggagaaggaggagaacctcgtgcgcagcatggtctccgccgggagcggcgaggtggacagcttctccctgggcatcctgtgcgccagcatcatgatcgaggaggtgatgcggtcccgctggagccggaagatgctcatgacggggaccctggccgtcttcctgctcctggtgatgggccagctgacctggaacgacctcatccgcctgtgcatcatggtgggggcgaacgcctccgaccgcatgggcatggggaccacgtacctggccctcatggccaccttcaagatgcggccgatgttcgccgtcgggctgctgttccgccggctcaccagccgcgaggtgctgctgctcaccatcggcctgtccctggtggcgagcgtcgagctccccaactccctggaggagctgggggacggcctcgccatggggatcatgatgctgaagctgctcacggagttccagccccaccagctgtggaccaccctgctcagcctgaccttcatcaagacgaccctgtccctcgactacgcctggaagaccaccgccatggcgctgagcatcgtgtccctgttccccctctgcctgagcacgacctcccagaagaccacctggctgccggtcctcctgggcagcttcggctgcaagcccctgaccatgttcctcatcacggagaacaagatctgggggcggaagtcctggcccctgaacgagggcatcatggccatcgggatcgtgagcatcctgctctccagcctgctgaagaacgacgtgcccctcgccggcccgctgatcgccgggggcatgctgatcgcctgctacgtcatcagcggctccagcgcggacctctccctggagaaggccgccgaggtgagctgggagcaggaggccgagcactccgggaccagccacaacatcctggtggaggtccaggacgacggcaccatgaagatcaaggacgaggagcgcgacgacaccctcacgatcctgctgaaggccaccctcctggcggtgtccggggtgtaccccatgagcatccccgccaccctgttcctctggtacttctggcagaagaagaagcagcggtccggcgtcctgtgggacacccccagcccgcccgaggtggagcgcgccgtgctggacgacgggatctaccggatcctgcagcgcggcctcctgggccggtcccaggtcggggtgggcgtgttccaggacggggtcttccacacgatgtggcacgtgacccgcggcgccgtgctgatgtaccaggggaagcggctcgagcccagctgggcctccgtcaagaaggacctgatcagctacggcggcgggtggcgcttccagggctcctggaacaccggggaggaggtccaggtgatcgcggtcgagcccggcaagaacccgaagaacgtgcagaccacgcccgggaccttcaagacccccgagggcgaggtgggcgccatcgccctggacttcaagcccgggaccagcggctccccgatcgtcaaccgggaggggaagatcgtgggcctctacggcaacggggtggtcacgaccagcggcacctacgtgtccgccatcgcccaggcgaaggccagccaggaggggcccctgcccgagatcgaggacgaggtgttcaagaagcgcaacctgaccatcatggacctccacccgggcagcgggaagacgcggcgctacctgcccgccatcgtccgggaggccatcaagcgcaagctgcggaccctcatcctggcgcccacccgcgtggtggcctccgagatggccgaggccctgaagggcatgcccatccgctaccagaccacggccgtcaagagcgagcacaccggccgggagatcgtggacctcatgtgccacgcgaccttcaccatgcgcctgctgtccccggtgcgggtccccaactacaacatgatcatcatggacgaggcccacttcacggaccccgccagcatcgccgcccgcgggtacatctccacccgggtgggcatgggggaggcggccgccatcttcatgaccgccacgccgcccggcagcgtggaggccttcccccagtccaacgcggtcatccaggacgaggagcgcgacatccccgagcggagctggaactccgggtacgactggatcacggacttccccggcaagaccgtgtggttcgtgcccagcatcaagtccggcaacgacatcgccaactgcctccgcaagaacgggaagcgggtcatccagctgagccgcaagaccttcgacaccgagtaccagaagacgaagaacaacgactgggactacgtggtgaccaccgacatctccgagatgggcgccaacttccgggccgaccgcgtcatcgacccccggcgctgcctgaagcccgtgatcctcaaggacgggcccgagcgggtgatcctggcgggcccgatgcccgtcaccgtggccagcgccgcccagcgccgggggcgcatcggccggaaccagaacaaggagggcgaccagtacgtgtacatggggcagcccctgaacaacgacgaggaccacgcccactggacggaggcgaagatgctcctggacaacatcaacacccccgagggcatcatcccggccctgttcgagcccgagcgcgagaagtccgccgccatcgacggggagtaccgcctccggggcgaggcccgcaagaccttcgtcgagctgatgcggcgcggggacctgcccgtgtggctcagctacaaggtcgcgtccgagggcttccagtacagcgaccggcgctggtgcttcgacggcgagcggaacaaccaggtgctggaggagaacatggacgtggagatctggaccaaggagggggagcgcaagaagctgcggccccgctggctcgacgcccggacctactccgacccgctggccctgcgcgagttcaaggagttcgccgccggccggcgcagcgtcagcggggacctcatcctggagatcggcaagctgccccagcacctcacgtcccgggcgcagaacgccctggacaacctggtgatgctccacaacagcgagcagggcgggaaggcctaccgccacgccatggaggagctgcccgacaccatcgagaccctgatgctcctggcgctgatcgccgtgctcaccggcggggtcacgctgttcttcctgtccggcaaggggctcggcaagaccagcatcggcctgctgtgcgtgaccgcctccagcgccctcctgtggatggcctccgtggagccccactggatcgcggccagcatcatcctggagttcttcctcatggtcctgctgatcccggagcccgaccggcagcgcacgccccaggacaaccagctcgcctacgtggtgatcgggctgctgttcatgatcctcacggtcgccgccaacgagatgggcctgctggagaccaccaagaaggacctcgggatcggccacgtggcggccgagaaccaccagcacgccaccatgctggacgtggacctgcggccggcctccgcctggacgctctacgcggtcgccaccaccgtgatcacccccatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtcaacccgctgacgctgaccgccgcggtgctcatgctggtggcccactacgccatcatcggccccgggctgcaggccaaggccacccgggaggcgcagaagcgcaccgccgccggcatcatgaagaaccccacggtcgacgggatcgtggccatcgacctcgaccccgtggtctacgacgccaagttcgagaagcagctgggccagatcatgctgctcatcctgtgcacctcccagatcctgctcatgcgcaccacctgggcgctgtgcgagagcatcacgctggccaccggcccgctcaccaccctgtgggaggggtcccccggcaagttctggaacacgaccatcgccgtgagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgagcaagagcgagttcaacacgtacaagcggtccgggatcatggaggtggaccgcagcgaggccaaggagggcctcaagcgcggggagaccaccaagcacgcggtctcccgcggcaccgccaagctgcggtggttcgtggagcgcaacctggtgaagcccgaggggaaggtcatcgacctgggctgcggccgcggcgggtggagctactactgcgccgggctcaagaaggtgaccgaggtgaaggggtacacgaagggcgggcccggccacgaggagccgatccccatggccacctacgggtggaacctggccaagctgcactccggcaaggacgtcttcttcatgccgcccgagaagtgcgacaccctcctgtgcgacatcggggagagctccccgaaccccaccatcgaggagggccgcacgctgcgggtgctcaagatggtggagccctggctgcgcgggaaccagttctgcatcaagatcctgaacccctacatgccgagcgtcgtggagaccctcgagcagatgcagcggaagcacggcggcatgctggtgcgcaaccccctgtcccggaacagcacccacgagatgtactgggtctcctgcgggaccggcaacatcgtgagcgcggtgaacatgacgtcccgcatgctcctgaaccggttcaccatggcccaccgcaagcccacctacgagcgcgacgtcgacctgggggccggcacccggcacgtggccgtggagcccgaggtcgccaacctcgacatcatcggccagcgcatcgagaacatcaagaacgagcacaagagcacgtggcactacgacgaggacaacccgtacaagacctgggcgtaccacgggtcctacgaggtcaagagctccggcagcgcctccagcatggtgaacggggtcgtgcggctgctgaccaagccctgggacgtgatccccatggtcacccagatcgccatgacggacaccacccccttcggccagcagcgcgtgttcaaggagaaggtcgacacccggacgccgcgcgccaagcgggggaccacccagatcatggaggtgaccgccaagtggctctggggcttcctgagccgcaacaagaagccccggatctgcacgcgcgaggagttcacccggaaggtgcgctccaacgcggccatcggcgccgtcttcgtggacgagaaccagtggaacagcgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtggagggcgaggggctccacaagctgggctacatcctgcgcgacatctccaagatccccgggggcaacatgtacgccgacgacaccgccggctgggacacgcggatcaccgaggacgacctccagaacgaggccaagatcaccgagatcatggagccggagcacgccctgctggcgaccagcatcttcaagctcacgtaccagaacaaggtcgtgcgcgtgcagcgccccgccaagaacgggaccgtcatggacgtgatctcccggcgcgaccagcggggcagcggccaggtgggcacctacggcctgaacaccttcacgaacatggaggtccagctgatccgccagatggagtccgaggggatcttcctccccagcgagctggagacccccaacctggccgagcgggtgctcgactggctggagaagcacggcgccgagcgcctgaagcggatggccatctccggggacgactgcgtggtcaagccgatcgacgaccgcttcgcgaccgccctcaccgccctgaacgacatgggcaaggtgcggaaggacatcccccagtgggagcccagcaaggggtggaacgactggcagcaggtccccttctgctcccaccacttccaccagctgatcatgaaggacggccgcgagatcgtcgtgccgtgccggaaccaggacgagctcgtgggccgcgcccgggtcagccagggggccggctggtccctgcgcgagaccgcgtgcctgggcaagagctacgcccagatgtggcagctcatgtacttccaccggcgcgacctgcggctggccgccaacgcgatctgcagcgccgtgcccgtggactgggtccccacgtcccgcaccacctggagcatccacgcccaccaccagtggatgaccacggaggacatgctctccgtgtggaaccgggtgtggatcgaggagaacccctggatggaggacaagacccacgtcagctcctgggaggaggtgccgtacctgggcaagcgcgaggaccagtggtgcgggagcctgatcggcctcaccgcccgcgccacctgggcgacgaacatccaggtggccatcaaccaggtccggcgcctgatcggcaacgagaactacctggactacatgacctccatgaagcggttcaagaacgagagcgaccccgagggggccctctggtga

SEQ ID NO: 8097 - RNA, 9879 nt, synthetic construct
  misc_feature 1..9879: note = derived and/or modified CDS sequence (opt1) from DENV-1__GQ868534__SS-prME
  source 1..9879: mol_type = other RNA
agcgtgaccatgctgctcatgctgctgcccaccgccctcgccttccacctgaccacccggggcggggagccgcacatgatcgtgagcaagcaggagcggggcaagagcctcctgttcaagacctccgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgtgagcatcatgatcgaggaggtcatgcggtcccgctggagccggaagatgctcatgacgggcaccctggccgtgttcctgctcctggtgatggggcagctgacctggaacgacctcatccgcctgtgcatcatggtcggcgccaacgcgtccgaccgcatggggatgggcaccacgtacctggccctcatggccaccttcaagatgcggccgatgttcgccgtggggctgctgttccgccggctcaccagccgcgaggtgctgctgctcaccatcgggctgtccctggtcgccagcgtggagctccccaactccctggaggagctgggcgacgggctcgcgatgggcatcatgatgctgaagctgctcacggagttccagccccaccagctgtggaccaccctgctcagcctgaccttcatcaagacgaccctgtccctcgactacgcctggaagaccaccgccatggccctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggccgtgtccggcgtctaccccatgagcatccccgcgaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcaccagcgggtccccgatcgtgaaccgggagggcaagatcgtcggcctgtacgggaacggcgtggtgacgaccagcgggacctacgtctccgccatcgcccaggccaaggcgagccaggagggccccctccccgagatcgaggacgaggtgttcaagaagcgcaacctgaccatcatggacctgcacccggggagcggcaagacgcggcgctacctccccgccatcgtgcgggaggccatcaagcgcaagctgcggaccctgatcctcgcccccacccgcgtcgtggcgtccgagatggccgaggccctgaagggcatgcccatccgctaccagaccacggccgtcaagagcgagcacaccgggcgggagatcgtcgacctgatgtgccacgccaccttcaccatgcgcctcctgtccccggtgcgggtgcccaactacaacatgatcatcatggacgaggcgcacttcacggaccccgccagcatcgccgcccgcggctacatctccacccgggtcgggatgggcgaggccgcggccatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgcgaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgccgggccgatgcccgtgaccgtcgcgagcgccgcccagcgccggggccgcatcggccggaaccagaacaaggagggggaccagtacgtgtacatgggccagcccctgaacaacgacgaggaccacgcccactggacggaggccaagatgctgctcgacaacatcaacacccccgaggggatcatcccggcgctgttcgagcccgagcgcgagaagaacgccgccatcgacggcgagtaccgcctgcgcggggaggcccgcaagaccttcgtcgagctcatgcggcgcggcgacctgcccgtgtggctgtcctacaaggtggccagcgagggcttccagtactccgaccggcgctggtgcttcgacggggagcggaacaaccaggtcctcgaggagaacatggacgtggagatctggaccaaggagggcgagcgcaagaagctgcggccccgctggctggacgcgcggacctacagcgacccgctcgccctgcgcgagttcaaggagttcgccgccgggcggcgctccgtgagcggcgacctgatcctcgagatcggcaagctgccccagcacctgacgctccgggcccagaacgcgctggacaacctggtcatgctccacaacagcgagcagggcgggaaggcctaccgccacgccatggaggagctgcccgacaccatcgagaccctgatgctcctggccctgatcgcggtgctcaccgggggcgtgacgctgttcttcctgtccgggaagggcctcggcaagaccagcatcgggctgctgtgcgtcaccgcctccagcgccctcctgtggatggcctccgtggagccccactggatcgccgcgagcatcatcctggagttcttcctcatggtgctgctgatcccggagcccgaccggcagcgcacgccccaggacaaccagctcgcctacgtcgtgatcggcctgctgttcatgatcctcacggtggccgccaacgagatggggctgctggagaccaccaagaaggacctcggcatcgggcacgtcgccgcggagaaccaccagcacgccaccatgctggacgtggacctgcggccggcctccgcctggacgctctacgccgtggcgaccaccgtcatcacccccatgatgcgccacacgatcgagaacaccaccgccaacatcagcctgaccgccatcgccaaccaggccgcgatcctgatgggcctcgacaagggctggcccatctccaagatggacatcggggtgcccctgctggccctcggctgctacagccaggtgaacccgctgacgctgaccgccgccgtcctcatgctggtggcgcactacgccatcatcgggcccggcctgcaggccaaggccacccgggaggcccagaagcgcaccgcggccgggatcatgaagaaccccacggtggacggcatcgtcgccatcgacctcgaccccgtggtgtacgacgccaagttcgagaagcagctgggccagatcatgctgctcatcctgtgcacctcccagatcctgctcatgcgcaccacctgggccctgtgcgagagcatcacgctggcgaccgggccgctcaccaccctgtgggagggctcccccgggaagttctggaacacgaccatcgccgtcagcatggccaacatcttccggggctcctacctggccggcgccgggctcgcgttcagcctgatgaagtccctgggcgggggccgccgggggaccggcgcccagggcgagaccctcggggagaagtggaagcgccagctgaaccagctgagcaagtccgagttcaacacgtacaagcggagcggcatcatggaggtggaccgcagcgaggccaaggaggggctcaagcggggcgagaccaccaagcacgccgtgtcccgcgggaccgcgaagctgcggtggttcgtcgagcgcaacctggtgaagcccgagggcaaggtgatcgacctgggctgcgggcggggcgggtggagctactactgcgccggcctcaagaaggtcaccgaggtgaaggggtacacgaagggcggccccgggcacgaggagccgatccccatggccacctacggctggaacctggtgaagctgcactccgggaaggacgtcttcttcatcccgcccgagaagtgcgacaccctcctgtgcgacatcggcgagagctccccgaaccccaccatcgaggaggggcgcacgctgcgggtgctcaagatggtggagccctggctgcgcggcaaccagttctgcatcaagatcctgaacccctacatgccgagcgtcgtggaggccctcgagcagatgcagcggaagcacggcgggatgctggtgcgcaaccccctgtcccggaacagcacccacgagatgtactgggtctcctgcggcaccgggaacatcgtgagcgccgtgaacatgacctcccgcatgctcctgaaccggttcacgatggcgcaccgcaagcccacctacgagcgcgacgtcgacctgggcgccggcacccggcacgtggccgtggagcccgaggtcgccaacctcgacatcatcgggcagcgcatcgagaacatcaagaacgagcacaagagcacctggcactacgacgaggacaacccgtacaagacgtgggcctaccacggctcctacgaggtgaagcccagcgggtccgcgagctccatggtgaacggcgtcgtgcggctgctgaccaagccctgggacgtcatccccatggtgacccagatcgccatgaccgacacgaccccgttcgggcagcagcgcgtgttcaaggagaaggtcgacacccggacgccccgggccaagcggggcacgacccagatcatggaggtgaccgccaagtggctctggggcttcctgagccgcaacaagaagccccggatctgcacccgcgaggagttcacgcggaaggtgcgctccaacgccgcgatcggggccgtcttcgtggacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggccctggggttcatgaacgaggaccactggttctcccgggagaacagcctgtccggcgtggagggggagggcctccacaagctggggtacatcctgcgcgacatcagcaagatcccgggcggcaacatgtacgcggacgacaccgccgggtgggacacccggatcacggaggacgacctccagaacgaggccaagatcaccgagatcatggagcccgagcacgccctgctggccacctccatcttcaagctcacctaccagaacaaggtcgtgcgcgtgcagcgccccgcgaagaacggcacggtcatggacgtgatcagccggcgcgaccagcgggggtccggccaggtgggcacctacgggctgaacaccttcaccaacatggaggtccagctgatccgccagatggagagcgagggcatcttcctcccctccgagctggagacgccgaacctggccgagcgggccctcgactggctggagaagcacggggccgagcgcctgaagcggatggccatcagcggcgacgactgcgtggtgaagcccatcgacgaccgcttcgcgaccgccctcaccgccctgaacgacatggggaaggtccggaaggacatcccccagtgggagccctccaagggctggaacgactggcagcaggtcccgttctgcagccaccacttccaccagctgatcatgaaggacggccgcgagatcgtggtcccctgccggaaccaggacgagctcgtggggcgcgcccgggtgtcccagggcgccgggtggagcctgcgcgagaccgcgtgcctgggcaagtcctacgcccagatgtggcagctcatgtacttccaccggcgcgacctgcggctggccgccaacgcgatctgcagcgccgtccccgtggactgggtgcccacctcccgcacgacctggagcatccacgcccaccaccagtggatgaccaccgaggacatgctcagcgtctggaaccgggtgtggatcgaggagaacccgtggatggaggacaagacgcacgtgtccagctgggaggaggtcccctacctggggaagcgcgaggaccagtggtgcggctccctgatcggcctcaccgcccgcgccacctgggcgaccaacatccaggtggccatcaaccaggtgcggcgcctgatcgggaacgagaactacctggactacatgacgagcatgaagcggttcaagaacgagtccgaccccgagggcgccctctggtga

SEQ ID NO: 8098 - RNA, 9879 nt, synthetic construct
  misc_feature 1..9879: note = derived and/or modified CDS sequence (opt1) from DENV-1__GQ868535__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcgcgaaccccgccatcctccgcaagctgtgcatcgaggccaagatcagcaacaccaccaccgactcccggtgcccgacgcagggcgaggccaccctggtggaggagcaggacgccaacttcgtgtgccgccggaccttcgtcgaccgcggctgggggaacggctgcggcctcttcggcaaggggagcctgctgacctgcgcgaagttcaagtgcgtgacgaagctcgagggcaagatcgtgcagtacgagaacctgaagtactccgtcatcgtgaccgtgcacaccggcgaccagcaccaggtcgggaacgagaccacggagcacggcaccatcgccaccatcacgccccaggcccccaccagcgagatccagctgacggactacggggccctcaccctggactgcagcccccggaccggcctggacttcaacgagatggtgctcctgaccatgaaggagaagtcctggctggtccacaagcagtggttcctcgacctgccgctgccctggacgtccggggccagcaccagccaggagacctggaaccgccaggacctcctggtgaccttcaagacggcgcacgccaagaagcaggaggtggtcgtgctgggctcccaggagggcgccatgcacaccgccctcaccggggccaccgagatccagacgagcggcaccaccaccatcttcgcggggcacctgaagtgccggctgaagatggacaagctcacgctgaagggcacctcctacgtgatgtgcaccgggagcttcaagctggagaaggaggtcgccgagacccagcacggcacggtgctggtgcaggtcaagtacgagggcaccgacgccccctgcaagatccccttctccacccaggacgagaagggggtgacccagaacggccgcctcatcacggccaacccgatcgtgaccgacaaggagaagcccgtcaacatcgagaccgagccgcccttcggggagagctacatcgtggtgggcgcgggcgagaaggccctgaagctgtcctggttcaagaaggggagctccatcggcaagatgttcgaggccaccgcccgcggggcccgccggatggcgatcctcggcgacacggcctgggacttcgggagcatcggcggcgtcttcacctccgtggggaagctggtgcaccaggtcttcggcaccgcctacggggtgctgttcagcggcgtgtcctggaccatgaagatcgggatcggcatcctcctgacgtggctgggcctcaacagccgctccaccagcctgtccatgacctgcatcgccgtcgggatggtgaccctgtacctcggcgtgatggtccaggccgacagcgggtgcgtgatcaactggaagggccgcgagctgaagtgcgggtccggcatcttcgtgacgaacgaggtccacacctggaccgagcagtacaagttccaggcggacagcccgaagcggctgagcgccgccatcggcaaggcctgggaggagggggtgtgcggcatccgctccgccacccggctcgagaacatcatgtggaagcagatcagcaacgagctgaaccacatcctgctcgagaacgacatgaagttcaccgtggtcgtgggggacgcgaacggcatcctggcccaggggaagaagatgatccgcccccagcccatggagcacaagtactcctggaagtcctggggcaaggccaagatcatcggcgccgacatccagaacacgaccttcatcatcgacgggcccgacaccccggagtgccccgacaaccagcgggcgtggaacatctgggaggtggaggactacggcttcgggatcttcaccacgaacatctggctgaagctccgcgactcctacacccagatgtgcgaccaccggctgatgagcgccgccatcaaggactccaaggccgtccacgccgacatgggctactggatcgagagcgagaagaacgagacctggaagctggcgcgcgcctccttcatcgaggtgaagacctgcacgtggcccaagagccacaccctctggtccaacggcgtgctggagagcgagatgatcatccccaagatctacgggggcccgatctcccagcacaactaccggcccgggtacttcacccagaccgccggcccctggcacctggggaagctcgagctggacttcgacctgtgcgagggcacgaccgtcgtggtggacgagcactgcggcaaccgcgggccgagcctccggaccaccacggtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgaccggcacgctggcggtcttcctgctcctgatcatggggcagctgacctggaacgacctcatccgcctgtgcatcatggtgggcgccaacgcctccgaccgcatggggatgggcaccacctacctggccctcatggccacgttcaagatgcggccgatgttcgcggtggggctgctgttccgccggctcaccagccgcgaggtcctgctgctcaccatcgggctgtccctggtggccagcgtggagctccccaactccctggaggagctgggcgacgggctcgccatgggcatcatgatgctgaagctgctcaccgagttccagccccaccagctgtggacgaccctgctcagcctgaccttcatcaagaccacgctgtccctcgactacgcctggaagaccaccgcgatggccctgagcatcgtctccctgttccccctctgcctgagcaccacgtcccagaagaccacctggctgccggtgctcctgggcagcttcgggtgcaagcccctgaccatgttcctcatcaccgagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcgtgctacgtgatcagcgggtccagcgccgacctctccctggagaaggccgccgaggtcagctgggagcaggaggccgagcactccggcacgagccacaacatcctggtggaggtgcaggacgacgggaccatgaagatcaaggacgaggagcgcgacgacaccctcaccatcctgctgaaggcgacgctcctggccgtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacaccatgtggcacgtgacgcgcggggccgtgctgatgtaccagggcaagcggctggagcccagctgggcgtccgtcaagaaggacctcatcagctacggcgggggctggcgcttccaggggtcctggaacatgggcgaggaggtccaggtgatcgccgtcgagcccgggaagaacccgaagaacgtgcagaccacccccggcaccttcaagacgcccgagggcgaggtgggggccatcgccctggacttcaagcccggcaccagcgggtccccgatcgtcaaccgggagggcaagatcgtgggcctgtacgggaacggcgtggtcaccaccagcgggacgtacgtgtccgccatcgcgcaggccaaggccagccaggagggccccctccccgagatcgaggacgaggtgttcaagaagcgcaacctgaccatcatggacctgcacccggggagcggcaagacccggcgctacctccccgccatcgtccgggaggcgatcaagcgcaagctgcggaccctgatcctcgcccccacgcgcgtggtggcctccgagatggccgaggccctgaagggcatgcccatccgctaccagaccaccgcggtcaagagcgagcacaccgggcgggagatcgtggacctgatgtgccacgccacgttcaccatgcgcctcctgtccccggtgcgggtccccaactacaacatgatcatcatggacgaggcccacttcaccgaccccgccagcatcgccgcgcgcggctacatctccacccgggtggggatgggcgaggccgccgccatcttcatgacggccacgccgcccgggagcgtggaggcgttcccccagtccaacgccgtcatccaggacgaggagcgcgacatccccgagcggagctggaactccggctacgactggatcaccgacttccccggcaagaccgtgtggttcgtgcccagcatcaagtccgggaacgacatcgccaactgcctgcgcaagaacggcaagcgggtcatccagctcagccgcaagacgttcgacaccgagtaccagaagaccaagaacaacgactgggactacgtggtgaccacggacatctccgagatgggggccaacttccgggcggaccgcgtcatcgacccccggcgctgcctgaagcccgtgatcctgaaggacggccccgagcgggtgatcctcgccgggccgatgcccgtcaccgtggccagcgccgcccagcgccggggccgcatcggccggaaccagaacaaggagggggaccagtacgtgtacatgggccagcccctgaacaacgacgaggaccacgcgcactggaccgaggccaagatgctgctcgacaacatcaacacccccgaggggatcatcccggccctgttcgagcccgagcgcgagaagtccgccgccatcgacggcgagtaccgcctgcgcggggaggcgcgcaagacgttcgtcgagctcatgcggcgcggcgacctgcccgtgtggctgagctacaaggtcgcctccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgcggggcggcgcagcgtcagcggcgacctgatcctcgagatcggcaagctgccccagcacctgaccctccgggcccagaacgccctggacaacctggtgatgctccacaactccgagcagggcgggaaggcctaccgccacgcgatggaggagctgcccgacaccatcgagacgctgatgctcctggccctgatcgccgtgctcaccgggggcgtcaccctgttcttcctgagcgggaagggcctcggcaagacctccatcgggctgctgtgcgtgacggccagctccgccctcctgtggatggcgagcgtggagccccactggatcgccgcctccatcatcctggagttcttcctcatggtcctgctgatcccggagcccgaccggcagcgcacgccccaggacaaccagctcgcctacgtggtgatcggcctgctgttcatgatcctcaccgtcgccgcgaacgagatggggctgctggagaccacgaagaaggacctcggcatcgggcacgtggccgccgagaaccaccagcacgccaccatgctggacgtggacctgcggccggccagcgcgtggaccctctacgccgtcgccaccacggtgatcacccccatgatgcgccacaccatcgagaacaccacggccaacatctccctgaccgccatcgcgaaccaggccgccatcctgatgggcctcgacaagggctggcccatcagcaagatggacatcggggtgcccctgctggccctcggctgctactcccaggtcaacccgctgaccctgaccgcggccgtgctcatgctggtggcccactacgccatcatcgggcccggcctgcaggccaaggcgacgcgggaggcccagaagcgcaccgccgccgggatcatgaagaaccccaccgtcgacggcatcgtggccatcgacctcgaccccgtggtctacgacgcgaagttcgagaagcagctgggccagatcatgctgctcatcctgtgcaccagccagatcctgctcatgcgcacgacctgggccctgtgcgagtccatcaccctggccaccgggccgctcacgaccctgtgggagggcagccccgggaagttctggaacaccaccatcgccgtgtccatggccaacatcttccggggcagctacctggcgggcgccgggctcgccttctccctgatgaagtccctgggcgggggccgccgggggacgggcgcccagggcgagaccctcggggagaagtggaagcgccagctgaaccagctgtccaagagcgagttcaacacctacaagcggagcggcatcatggaggtggaccgctccgaggcgaaggaggggctcaagcggggcgagaccacgaagcacgccgtcagccgcgggaccgccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacaccaagggcggccccgggcacgaggagccgatccccatggccacctacggctggaacctggtcaagctgcacagcgggaaggacgtgttcttcatgccgcccgagaagtgcgacacgctcctgtgcgacatcggcgagtccagcccgaaccccaccatcgaggaggggcgcaccctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacgcacgagatgtactgggtgagctgcggcaccgggaacatcgtgtccgcggtcaacatgaccagccgcatgctcctgaaccggttcaccatggcccaccgcaagcccacgttcgagcgcgacgtggacctgggcgccggcacccggcacgtggccgtcgagcccgaggtggccaacctcgacatcatcgggcagcgcatcgagaacatcaagaacgagcacaagtccacctggcactacgacgaggacaacccgtacaagacctgggcgtaccacggcagctacgaggtgaagccctccgggagcgcctccagcatggtcaacggcgtggtgcggctgctgacgaagccctgggacgtcatccccatggtgacccagatcgccatgaccgacaccacgccgttcgggcagcagcgcgtcttcaaggagaaggtggacacccggacgccccgggccaagcggggcaccacgcagatcatggaggtgaccgccaagtggctctggggcttcctgtcccgcaacaagaagccccggatctgcacccgcgaggagttcacccggaaggtccgcagcaacgcggccatcggggccgtgttcgtggacgagaaccagtggaacagcgccaaggaggcggtcgaggacgagcggttctgggacctggtgcaccgcgagcgggagctccacaagcagggcaagtgcgccacgtgcgtgtacaacatgatggggaagcgcgagaagaagctgggcgagttcgggaaggccaagggctcccgggccatctggtacatgtggctgggcgcccgcttcctcgagttcgaggcgctggggttcatgaacgaggaccactggttcagccgggagaactccctgagcggcgtcgagggggagggcctccacaagctggggtacatcctgcgcgacatctccaagatcccgggcggcaacatgtacgccgacgacaccgccgggtgggacacccggatcaccgaggacgacctccagaacgaggccaagatcacggacatcatggagcccgagcacgccctgctggcgaccagcatcttcaagctcacctaccagaacaaggtggtgcgcgtccagcgccccgccaagaacggcaccgtgatggacgtgatctcccggcgcgaccagcgggggagcggccaggtcggcacgtacgggctgaacaccttcaccaacatggaggtgcagctgatccgccagatggagtccgagggcatcttcctccccagcgagctggagaccccgaacctggccgagcgggtgctcgactggctggagaagcacggggccgagcgcctgaagcggatggccatctccggcgacgactgcgtcgtgaagcccatcgacgaccgcttcgcgacggccctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagaccgcgtgcctgggcaagagctacgcccagatgtggcagctcatgtacttccaccggcgcgacctgcggctggccgccaacgcgatctgctccgccgtgcccgtcgactgggtgcccaccagccgcaccacgtggagcatccacgcccaccaccagtggatgaccaccgaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcacggcccgcgccacctgggcgaccaacatccaggtcgccatcaaccaggtgcggcgcctgatcgggaacgagaactacctggactacatgacctccatgaagcggttcaagaacgagagcgaccccgagggcgccctctggtga

SEQ ID NO: 8099 - RNA, 9879 nt, synthetic construct
  misc_feature 1..9879: note = derived and/or modified CDS sequence (opt1) from DENV-1__KJ189306__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacgtgggtgacctacgggacctgcagccagaccggcgagcaccggcgggacaagcgctccgtggccctggcgccccacgtgggcctggggctcgagacgcggaccgagacctggatgagcagcgagggcgcctggaagcagatccagcgcgtggagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctgttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggcccttcaagctggagaaggaggtcgcggagacgcagcacggcaccgtgctggtgcaggtcaagtacgagggcaccgacgccccctgcaagatcccgttcctcacccaggacgagaagggggtgacgcagaacggccgcctgatcaccgccaaccccatcgtgaccgacaaggagaagcccgtcaacatcgagaccgagcccccgttcggggagagctacatcgtggtgggcgccggcgagaaggcgctgaagctctcctggttcaagaaggggagctccatcggcaagatgttcgaggccacggcccgcggggcccgccggatggccatcctgggcgacaccgcgtgggacttcgggagcatcggcggcgtcttcacctccgtggggaagctggtgcaccaggtcttcggcaccgcctacggggtcctgttcagcggcgtgtcctggacgatgaagatcgggatcggcatcctgctgacctggctcggcctgaacagccgctccaccagcctgtccatgacctgcatcgccgtcgggatggtgacgctctacctgggcgtgatggtccaggccgacagcgggtgcgtgatcaactggaagggccgcgagctgaagtgcgggtccggcatcttcgtgaccaacgaggtccacacctggaccgagcagtacaagttccaggccgacagccccaagcggctctccgcggccatcggcaaggcctgggaggagggggtgtgcggcatccgcagcgccacccggctggagaacatcatgtggaagcagatcagcaacgagctgaaccacatcctcctggagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggccggacacccccgagtgccccgacaaccagcgggcctggaacatctgggaggtggaggactacggcttcgggatcttcacgaccaacatctggctcaagctgcgcgactcctacacccagatgtgcgaccaccggctgatgagcgcggccatcaaggactccaaggccgtccacgccgacatgggctactggatcgagagcgagaagaacgagacctggaagctcgcccgcgcgtccttcatcgaggtgaagacgtgcacctggcccaagagccacaccctgtggtccaacggcgtgctggagagcgagatgatcatcccgaagatctacgggggccccatctcccagcacaactaccggcccgggtacttcacccagacggccggcccgtggcacctcgggaagctggagctggacttcgacctctgcgagggcaccaccgtcgtggtggacgagcactgcggcaaccgcgggcccagcctgcggaccacgaccgtcaccggcaagatcatccacgagtggtgctgccgctcctgcaccctgccgcccctccggttccgcggggaggacggctgctggtacgggatggagatccggccggtgaaggagaaggaggagaacctggtgcgcagcatggtctccgccggcagcggcgaggtggactccttcagcctggggatcctctgcgtgagcatcatgatcgaggaggtcatgcggtcccgctggagccggaagatgctgatgacgggcaccctggccgtgttcctcctgctggtgatggggcagctcacctggaacgacctgatccgcctgtgcatcatggtcggcgccaacgcgtccgaccgcatggggatgggcaccacgtacctcgccctgatggccaccttcaagatgcggcccatgttcgccgtggggctcctcttccgccggctgaccagccgcgaggtgctgctcctgaccatcgggctgtccctcgtcgccagcgtggagctgcccaactccctggaggagctcggcgacgggctggcgatgggcatcatgatgctgaagctcctgacggagttccagccccaccagctgtggaccaccctcctgagcctgaccttcatcaagacgaccctctccctggactacgcctggaagaccaccgccatggccctgagcatcgtctccctcttcccgctgtgcctgagcacgacctcccagaagaccacctggctccccgtgctgctgggcagcttcgggtgcaagcccctcaccatgttcctgatcacggagaacaagatctggggccggaagtcctggcccctgaacgaggggatcatggcgatcggcatcgtgagcatcctcctgtccagcctgctcaagaacgacgtcccgctggccgggcccctgatcgccggcggcatgctcatcgcctgctacgtgatctccgggagcagcgccgacctgtccctggagcgcgcggccgaggtgagctgggagcaggaggccgagcactccggcaccagccacaacatcctcgtcgaggtgcaggacgacgggaccatgaagatcaaggacgaggagcgggacgacaccctgacgatcctgctcaaggccaccctgctggccgtgtccggcgtctaccccatgagcatccccgcgaccctcttcgtgtggtacttctggcagaagaagaagcagcgctccggggtgctgtgggacaccccgtccccgcccgaggtcgagcgggccgtgctggacgacggcatctaccgcatcctgcagcggggcctcctggggcgctcccaggtgggcgtcggggtgttccaggacggcgtgttccacacgatgtggcacgtcacccgcggggccgtgctgatgtaccagggcaagcgcctcgagcccagctgggcctccgtgaagaaggacctgatcagctacggcgggggctggcggttccaggggtcctggaacaccggcgaggaggtccaggtgatcgccgtggagccggggaagaaccccaagaacgtccagaccacgcccggcaccttcaagacccccgagggcgaggtgggggcgatcgccctggacttcaagccgggcaccagcgggtcccccatcgtgaaccgcgagggcaagatcgtcggcctctacgggaacggcgtggtgacgaccagcgggacctacgtctccgccatcgcccaggccaaggcgagccaggagggccccctgccggagatcgaggacgaggtgttcaagaagcggaacctgaccatcatggacctccaccccgggtccggcaagacgcgccggtacctgcccgccatcgtgcgcgaggccatcaagcggaagctgcgcaccctcatcctggcccccacccgcgtcgtggcgagcgagatggccgaggccctgaagggcatgccgatccggtaccagaccacggccgtcaagagcgagcacaccgggcgcgagatcgtcgacctcatgtgccacgccaccttcaccatgcggctgctgtcccccgtgcgcgtgcccaactacaacatgatcatcatggacgaggcgcacttcacggaccccgccagcatcgccgcccggggctacatctccacccgcgtcgggatgggcgaggccgcggccatcttcatgaccgccaccccgcccgggagcgtggaggccttcccccagtccaacgccgtgatccaggacgaggagcgggacatccccgagcgcagctggaactccggctacgactggatcacggacttcccgggcaagaccgtctggttcgtgcccagcatcaagtccgggaacgacatcgcgaactgcctccggaagaacggcaagcgcgtgatccagctgagccggaagaccttcgacaccgagtaccagaagacgaagaacaacgactgggactacgtcgtgaccaccgacatctccgagatgggggccaacttccgcgccgaccgggtgatcgacccccgccggtgcctgaagcccgtcatcctcaaggacggcccggagcgcgtgatcctggccgggcccatgcccgtgaccgtcgcgagcgccgcccagcggcgcggccggatcggccgcaaccagaacaaggagggggaccagtacgtgtacatgggccagcccctgaacaacgacgaggaccacgcccactggacggaggccaagatgctcctggacaacatcaacaccccggaggggatcatccccgcgctgttcgagcccgagcgcgagaagtccgccgccatcgacggcgagtaccggctccgcggggaggcccggaagaccttcgtcgagctgatgcgccggggcgacctgcccgtgtggctcagctacaaggtggcctccgagggcttccagtacagcgaccgccggtggtgcttcgacggggagcgcaacaaccaggtcctggaggagaacatggacgtggagatctggaccaaggagggcgagcggaagaagctgcgcccgcggtggctcgacgcgcgcacctactccgaccccctggccctgcgggagttcaaggagttcgccgccgggcgccggagcgtgtccggcgacctcatcctggagatcggcaagctgccccagcacctcacgctgcgcgcccagaacgcgctggacaacctcgtcatgctgcacaacagcgagcagggcgggaaggcctaccggcacgccatggaggagctgcccgacaccatcgagaccctcatgctgctggccctcatcgcggtgctgaccgggggcgtgacgctgttcttcctcagcgggaagggcctgggcaagacctccatcgggctgctctgcgtcaccgccagctccgccctgctgtggatggccagcgtggagccgcactggatcgccgcgtccatcatcctcgagttcttcctgatggtgctgctcatccccgagcccgaccgccagcggaccccgcaggacaaccagctggcctacgtcgtgatcggcctcctcttcatgatcctgacggtggccgccaacgagatggggctgctcgagaccaccaagaaggacctgggcatcgggcacgtcgccgcggagaaccaccagcacgccaccatgctggacgtggacctccgccccgccagcgcctggacgctgtacgccgtggcgaccaccgtcatcacccccatgatgcggcacacgatcgagaacaccaccgccaacatctccctgaccgccatcgccaaccaggccgcgatcctcatgggcctggacaagggctggcccatcagcaagatggacatcggggtgccgctgctcgccctgggctgctactcccaggtgaaccccctgacgctcaccgccgccgtcctgatgctggtggcgcactacgccatcatcgggcccggcctccaggccaaggccacccgcgaggcccagaagcgcaccgcggccgggatcatgaagaaccccacggtggacggcatcgtcgccatcgacctggacccggtggtgtacgacgccaagttcgagaagcagctgggccagatcatgctcctgatcctgtgcaccagccagatcctcctgatgcggaccacctgggccctgtgcgagtccatcacgctcgcgaccgggcccctgaccaccctgtgggagggcagccccgggaagttctggaacacgaccatcgccgtctccatggccaacatcttccgcggcagctacctcgccggcgccgggctggcgttctccctgatgaagtccctcggcgggggccggcgcgggaccggcgcccagggcgagaccctgggggagaagtggaagcggcagctgaaccagctctccaagagcgagttccacatctacaagcgctccggcatcatggaggtggaccggagcgaggccaaggaggggctgaagcgcggcgagacgaccaagcacgccgtgagccgggggaccgcgaagctgcgctggttcgtcgagcggaacctggtgaagcccgagggcaaggtgatcgacctcggctgcgggcgcggcgggtggtcctactactgcgccggcctgaagaaggtcaccgaggtgaaggggtacaccaagggcggcccggggcacgaggagcccatccccatggccacgtacggctggaacctggtgaagctccacagcgggaaggacgtcttcttcatgcccccggagaagtgcgacaccctgctgtgcgacatcggcgagtccagccccaaccccaccatcgaggaggggcggaccctccgcgtgctgaagatggtggagccctggctgcggggcaaccagttctgcatcaagatcctcaacccgtacatgccctccgtcgtggagacgctggagcagatgcagcgcaagcacggcgggatgctggtgcggaaccccctcagccgcaactccacccacgagatgtactgggtcagctgcggcaccgggaacatcgtgtccgccgtgaacatgaccagccggatgctgctgaaccgcttcacgatggcccaccgcaagcccacctacgagcgggacgtcgacctcggcgcgggcacccgccacgtggccgtggagccggaggtcgccaacctggacatcatcgggcagcggatcgagaacatcaagaacgagcacaagtccacctggcactacgacgaggacaacccctacaagacgtgggcctaccacggcagctacgaggtgaagccctccgggagcgcctccagcatggtgaacggcgtcgtgcgcctgctcaccaagccctgggacgtcatcccgatggtgacccagatcgcgatgaccgacacgacccccttcgggcagcagcgggtgttcaaggagaaggtcgacacccgcacgccccgggccaagcgcggcacgacccagatcatggaggtgaccgccaagtggctgtggggcttcctgtcccggaacaagaagccgcgcatctgcacccgggaggagttcatccgcaaggtgcggagcaacgccgccatcggggcggtcttcgtggacgagaaccagtggaactccgccaaggaggccgtggaggacgagcgcttctgggacctcgtccaccgggagcgcgagctgcacaagcagggcaagtgcgccacgtgcgtgtacaacatgatggggaagcgggagaagaagctgggcgagttcgggaaggcgaagggcagccgcgccatctggtacatgtggctcggcgcccggttcctggagttcgaggccctggggttcatgaacgaggaccactggttcagccgcgagaactccctcagcggcgtggagggggagggcctgcacaagctggggtacatcctccgggacatctccaagatccccggcggcaacatgtacgccgacgacaccgcggggtgggacacccgcatcaccgaggacgacctgcagaacgaggccaagatcacggagatcatggagcccgagcacgccctgctcgccaccagcatcttcaagctgacctaccagaacaaggtcgtgcgcgtgcagcggcccgccaagaacggcaccgtcatggacgtgatctcccgccgggaccagcgcgggagcggccaggtgggcacgtacgggctgaacaccttcaccaacatggaggtccagctcatccggcagatggagtccgagggcatcttcctgccgagcgagctggagacccccaacctcgcggagcgcgtgctggactggctggagaagcacggggccgagcggctcaagcgcatggccatctccggcgacgactgcgtggtcaagcccatcgacgaccggttcgccacggccctgaccgcgctgaacgacatggggaaggtgcgcaaggacatcccccagtgggagccgagcaagggctggaacgactggcagcaggtccccttctgctcccaccacttccaccagctcatcatgaaggacggccgggagatcgtcgtgccctgccgcaaccaggacgagctggtggggcgggcccgcgtcagccagggcgccgggtggtccctgcgggagaccgcctgcctcggcaagagctacgcccagatgtggcagctgatgtacttccaccgccgggacctgcgcctcgcggccaacgccatctgctccgccgtgcccgtggactgggtcccgaccagccggaccacgtggtccatccacgcgcaccaccagtggatgaccaccgaggacatgctgagcgtgtggaaccgcgtgtggatcgaggagaacccctggatggaggacaagacccacgtcagctcctgggaggaggtgccctacctggggaagcgcgaggaccagtggtgcggcagcctcatcggcctgacggcccgggccacctgggccaccaacatccaggtggccatcaaccaggtccgccggctgatcgggaacgagaactacctcgactacatgacctccatgaagcgcttcaagaacgagagcgaccccgagggcgcgctgtggtga

SEQ ID NO: 8100 - RNA, 9879 nt, synthetic construct
  misc_feature 1..9879: note = derived and/or modified CDS sequence (opt1) from DENV-1__KJ189307__SS-prME
  source 1..9879: mol_type = other RNA
agcgtgaccatgctgctcatgctgctgcccaccgccctcgccttccacctgacgacccgcggcggggagccgcacatgatcgtctccaagcaggagcggggcaagagcctgctcttcaagacctccgcgggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtcacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcacccggggttcacggtgatcgccttcttcctggcgcacgccatcggcaccagcatcacccagaaggggatcatcttcatcctcctgatgctggtgaccccctccatggccatgcgctgcgtcggcatcggcaaccgggacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcgatcctgcgcaagctctgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcgggctgttcggcaaggggagcctcctgacgtgcgccaagttcaagtgcgtgaccaagctggagggcaagatcgtgcagtacgagaacctcaagtactccgtcatcgtgaccgtgcacaccggcgaccagcaccaggtcgggaacgagacgaccgagcacggcaccatcgcgaccatcaccccccaggcccccacgagcgagatccagctgaccgactacggggccctgaccctcgactgctccccccggaccggcctggacttcaacgagatggtgctgctcacgatgaaggagaagagctggctggtccacaagcagtggttcctggacctcccgctgccctggacctccggggccagcaccagccaggagacctggaaccgccaggacctgctcgtgacgttcaagaccgcccacgcgaagaagcaggaggtggtcgtgctgggctcccaggagggcgccatgcacaccgccctgaccggggccacggagatccagaccagcggcaccaccacgatcttcgccgggcacctcaagtgccggctgaagatggacaagctgaccctcaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctgatcaccgccaacccgatcgtgaccgacaaggagaagcccgtcaacatcgagaccgagccccccttcggggagagctacatcgtggtgggcgccggcgagaaggcgctcaagctgtcctggttcaagaaggggagctccatcggcaagatgttcgaggccacggcccggggggcccgccggatggccatcctgggcgacaccgcgtgggacttcgggagcatcggcggcgtcttcacctccgtggggaagctcgtgcaccaggtcttcggcaccgcctacggggtgctgttcagcggcgtgtcctggacgatgaagatcgggatcggcatcctgctcacctggctgggcctgaacagccgctccaccagcctctccatgacctgcatcgccgtcgggatggtgacgctgtacctgggcgtgatggtccaggccgacagcgggtgcgtgatcaactggaagggccgcgagctcaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcacggtggtcgtgggggacgccaacggcatcctcgcgcaggggaagaagatgatccgcccccagcccatggagcacaagtactcctggaagagctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctgcgcgactcctacacccagatgtgcgaccaccggctcatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctgtggtccaacggcgtgctcgagagcgagatgatcatccccaagatctacgggggcccgatctcccagcacaactaccggcccgggtacttcacccagacggccggcccctggcacctggggaagctggagctcgacttcgacctgtgcgagggcaccaccgtcgtggtggacgagcactgcggcaaccgcgggccgagcctgcggaccacgaccgtcaccggcaagatcatccacgagtggtgctgccgctcctgcaccctcccccccctgcggttccgcggggaggacggctgctggtacgggatggagatccggcccgtgaaggagaaggaggagaacctggtgcgcagcatggtctccgccggcagcggcgaggtggacagcttctccctcgggatcctgtgcgtgagcatcatgatcgaggaggtcatgcggtcccgctggagccggaagatgctgatgacgggcaccctcgccgtgttcctgctgctcgtgatggggcagctgacctggaacgacctgatccgcctctgcatcatggtcggcgccaacgcgtccgaccgcatggggatgggcaccacgtacctggccctgatggccaccttcaagatgcggccgatgttcgccgtgggcctcctgttccgccggctgaccagccgcgaggtgctcctgctgaccatcgggctctccctggtcgccagcgtggagctgcccaactccctcgaggagctgggcgacgggctggcgatgggcatcatgatgctcaagctgctgacggagttccagccccaccagctctggaccaccctgctgagcctcaccttcatcaagacgaccctgtccctggactacgcctggaagaccaccgccatggccctcagcatcgtctccctgttccccctgtgcctcagcacgacctcccagaagaccacctggctgccggtgctgctcggcagcttcgggtgcaagcccctgaccatgttcctgatcacggagaacaagatctggggccggaagtcctggcccctcaacgaggggatcatggcgatcggcatcgtgagcatcctgctgtccagcctcctgaagaacgacgtccccctggccgggccgctcatcgccggcggcatgctgatcgcctgctacgtgatcagcgggtccagcgccgacctgtccctcgagaaggcggccgaggtgagctgggagcaggaggccgagcactccggcaccagccacaacatccccgtcgaggtgcaggacgacgggaccatgaagatcaaggacgaggagcgcgacgacaccctgacgatcctgctcaaggccaccctgctggccgtgtccggcgtctaccccatgagcatccccgcgaccctcttcgtgtggtacttctggcagaagaagaagcagcggtccggggtgctgtgggacaccccgagcccccccgaggtcgagcgcgccgtgctggacgacggcatctaccggatcctccagcgcggcctgctggggcggtcccaggtgggcgtcggggtgttccaggacggcgtgttccacacgatgtggcacgtcacccgcggggccgtgctgatgtaccagggcaagcggctcgagcccagctgggcctccgtgaagaaggacctgatcagctacggcgggggctggcgcttccaggggtcctggaacaccggcgaggaggtccaggtgatcgccgtggagccggggaagaaccccaagaacgtccagaccacgcccggcaccttcaagacccccgagggcgaggtgggggcgatcgccctggacttcaagccgggcaccagcgggtcccccatcgtgaaccgggagggcaagatcgtcggcctctacgggaacggcgtggtgacgaccagcgggacctacgtctccgccatcgcccaggccaaggcgagccaggagggccccctgccggagatcgaggacgaggtgttcaagaagcgcaacctgaccatcatggacctccaccccgggagcggcaagacgcggcgctacctgcccgccatcgtgcgggaggccatcaagcgcaagctgcggaccctcatcctggcccccacccgcgtcgtggcgtccgagatggccgaggccctgaagggcatgccgatccgctaccagaccacggccgtgaagagcgagcacaccgggcgggagatcgtcgacctcatgtgccacgccaccttcaccatgcgcctgctgtcccccgtgcgggtgcccaactacaacatgatcatcatggacgaggcgcacttcacggaccccgccagcatcgccgcccgcggctacatctccacccgggtcgggatgggcgaggccgcggccatcttcatgaccgccaccccgcccgggagcgtggaggccttcccccagtccaacgccgtgatccaggacgaggagcgcgacatccccgagcggagctggaactccggctacgactggatcacggacttcccgggcaagaccgtctggttcgtgcccagcatcaagtccgggaacgacatcgcgaactgcctccgcaagaacggcaagcgggtgatccagctgagccgcaagaccttcgacaccgagtaccagaagacgaagaacaacgactgggactacgtcgtgaccaccgacatctccgagatgggggccaacttccgggccgaccgcgtgatcgacccccggcgctgcctgaagcccgtcatcctcaaggacggcccggagcgggtgatcctggccgggcccatgcccgtgaccgtcgcgagcgccgcccagcgccggggccgcatcggccggaaccagaacaaggagggggaccagtacgtgtacatgggccagcccctgaacaacgacgaggaccacgcccactggacggaggccaagatgctcctggacaacatcaacaccccggaggggatcatccccgcgctgttcgagcccgagcgcgagaagaacgccgccatcgacggcgagtaccgcctccggggggaggcccgcaagaccttcgtcgagctgatgcggcgcggcgacctgcccgtgtggctctcctacaaggtggccagcgagggcttccagtactccgaccggcgctggtgcttcgacggggagcggaacaaccaggtcctggaggagaacatggacgtggagatctggaccaaggagggcgagcgcaagaagctgcggccgcgctggctcgacgcgcggacctacagcgaccccctggccctgcgcgagttcaaggagttcgccgccgggcggcgctccgtgagcggcgacctcatcctggagatcggcaagctgccccagcacctcacgctgcgggcccagaacgcgctggacaacctcgtcatgctgcacaacagcgagcaggggggcaaggcctaccgccacgccatggaggagctgcccgacaccatcgagaccctcatgctgctggccctcatcgcggtgctgaccgggggcgtgacgctgttcttcctctccgggaagggcctgggcaagaccagcatcgggctgctctgcgtcaccgcctccagcgccctgctgtggatggcctccgtggagccgcactggatcgccgcgagcatcatcctcgagttcttcctgatggtgctgctcatccccgagcccgaccggcagcgcaccccgcaggacaaccagctggcctacgtcgtgatcggcctgctcttcatgatcctgacggtggccgccaacgagatggggctgctcgagaccaccaagaaggacctgggcatcgggcacgtcgccgcggagaaccaccagcacgccaccatgctggacgtggacctccggcccgcctccgcctggacgctgtacgccgtggcgaccaccgtcatcacccccatgatgcgccacacgatcgagaacaccaccgccaacatcagcctgaccgccatcgccaaccaggccgcgatcctcatgggcctggacaagggctggcccatctccaagatggacatcggggtgccgctgctcgccctgggctgctacagccaggtgaaccccctgacgctcaccgccgccgtcctgatgctggtggcgcactacgccatcatcgggcccggcctccaggccaaggccacccgggaggcccagaagcgcaccgcggccgggatcatgaagaaccccacggtggacggcatcgtcgccatcgacctggacccggtggtgtacgacgccaagttcgagaagcagctgggccagatcatgctcctgatcctgtgcacctcccagatcctcctgatgcgcaccacctgggccctgtgcgagagcatcacgctcgcgaccgggcccctgaccaccctgtgggagggctcccccgggaagttctggaacacgaccatcgccgtcagcatggccaacatcttccggggctcctacctcgccggcgccgggctggcgttcagcctgatgaagtccctcggcgggggccgccgggggaccggcgcccagggcgagaccctgggggagaagtggaagcgccagctgaaccagctcagcaagtccgagttcaacacgtacaagcggagcggcatcatggaggtggaccgcagcgaggccaaggaggggctgaagcggggcgagaccaccaagcacgccgtgtcccgcgggaccgcgaagctgcggtggttcgtcgagcgcaacctcgtgaagcccgagggcaaggtgatcgacctgggctgcgggcggggcgggtggagctactactgcgccggcctgaagaaggtcaccgaggtgaaggggtacacgaagggcggcccggggcacgaggagcccatccccatggccacctacggctggaacctggtgaagctccactccgggaaggacgtcttcttcatgcccccggagaagtgcgacaccctgctgtgcgacatcggcgagagctcccccaaccccaccatcgaggaggggcgcacgctccgggtgctgaagatggtggagccctggctgcgcggcaaccagttctgcatcaagatcctcaacccgtacatgcccagcgtcgtggagaccctggagcagatgcagcggaagcacggcgggatgctggtgcgcaaccccctctcccggaacagcacccacgagatgtactgggtctcctgcggcaccgggaacatcgtgagcgccgtgaacatgacgtcccgcatgctgctgaaccggttcaccatggcccaccgcaagcccacctacgagcgcgacgtcgacctcggcgcgggcacccggcacgtggccgtggagccggaggtcgccaacctggacatcatcgggcagcgcatcgagaacatcaagaacgagcacaagagcacgtggcactacgacgaggacaacccctacaagacctgggcctaccacggctcctacgaggtgaagcccagcgggtccgccagctccatggtgaacggcgtcgtgcggctgctcaccaagccctgggacgtcatcccgatggtgacccagatcgcgatgacggacaccacccccttcgggcagcagcgcgtgttcaaggagaaggtcgacacccggacgccccgcgccaagcggggcaccacccagatcatggaggtgaccgccaagtggctgtggggcttcctgagccgcaacaagaagccgcggatctgcacgcgcgaggagttcacccggaaggtgcgctccaacgccgccatcggggcggtcttcgtggacgagaaccagtggaacagcgccaaggaggccgtggaggacgagcggttctgggacctcgtccaccgcgagcgggagctgcacaagcagggcaagtgcgccacctgcgtgtacaacatgatggggaagcgcgagaagaagctgggcgagttcgggaaggcgaagggcagccgggccatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgccgacgacaccgcggggtgggacacgcggatcaccgaggacgacctgcagaacgaggccaagatcaccgagatcatggagcccgagcacgccctgctcgccacctccatcttcaagctgacgtaccagaacaaggtcgtgcgcgtgcagcgccccgccaagaacggcaccgtcatggacgtgatcagccggcgcgaccagcgggggtccggccaggtgggcacctacgggctgaacaccttcacgaacatggaggtccagctcatccgccagatggagagcgagggcatcttcctgccgtccgagctggagacccccaacctcgcggagcgggtgctggactggctggagaagcacggggccgagcgcctcaagcggatggccatcagcggcgacgactgcgtggtcaagcccatcgacgaccgcttcgccaccgccctgaccgcgctgaacgacatggggaaggtgcggaaggacatcccccagtgggagccgtccaagggctggaacgactggcagcaggtgcccttctgcagccaccacttccaccagctcatcatgaaggacggccgcgagatcgtcgtgccctgccggaaccaggacgagctggtggggcgcgcccgggtctcccagggcgccgggtggagcctgcgcgagaccgcctgcctcggcaagtcctacgcccagatgtggcagctgatgtacttccaccggcgcgacctgcggctcgcggccaacgccatctgcagcgccgtgcccgtggactgggtcccgacgtcccgcaccacctggagcatccacgcgcaccaccagtggatgaccacggaggacatgctgagcgtgtggaaccgggtgtggatcgaggagaacccctggatggaggacaagacccacgtctccagctgggaggaggtgccctacctggggaagcgcgaggaccagtggtgcggctccctcatcggcctgaccgcccgcgccacctgggccacgaacatccaggtggccatcaaccaggtccggcgcctgatcgggaacgagaactacctcgactacatgaccagcatgaagcggttcaagaacgagtccgaccccgagggcgcgctgtggtga

SEQ ID NO: 8101 - RNA, 9879 nt, synthetic construct
  misc_feature 1..9879: note = derived and/or modified CDS sequence (opt1) from DENV-1__KJ189318__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtcacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtgggcctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaagaccgccgaggtcagctgggagcaggaggccgagcactccggcaccagccacaacatcctggtggaggtgcaggacgacgggaccatgaagatcaaggacgaggagcgcgacgacacgctcaccatcctgctgaaggccaccctcctggccgtctccggcgtgtaccccatgagcatccccgcgaccctgttcgtgtggtacttctggcagaagaagaagcagcggtccggggtcctctgggacacgcccagcccgcccgaggtggagcgcgccgtgctggacgacggcatctaccggatcctgcagcgcggcctgctcgggcggtcccaggtcggcgtgggggtgttccaggacggcgtcttccacaccatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgccgtcgagcccgggaagaacccgaagaacgtgcagacgacccccggcaccttcaagacccccgagggcgaggtgggggcgatcgccctggacttcaagcccggcacgagcgggtccccgatcgtcaaccgggagggcaagatcgtgggcctgtacgggaacggcgtggtcaccaccagcgggacctacgtgtccgccatcgcccaggccaaggcgagccaggagggccccctccccgagatcgaggacgaggtgttcaagaagcgcaacctgacgatcatggacctgcacccggggagcggcaagacccggcgctacctccccgccatcgtccgggaggccatcaagcgcaagctgcggaccctgatcctcgcccccacccgcgtggtggcgtccgagatggccgaggccctgaagggcatgcccatccgctaccagacgaccgccgtcaagagcgagcacaccgggcgggagatcgtggacctgatgtgccacgccaccttcacgatgcgcctcctgtccccggtgcgggtccccaactacaacatgatcatcatggacgaggcgcacttcaccgaccccgccagcatcgccgcccgcggctacatctccacccgggtggggatgggcgaggccgcggccatcttcatgaccgccacgcccccggggagcgtggaggccttcccccagtccaacgccgtcatccaggacgaggagcgcgacatccccgagcggagctggaactccggctacgactggatcaccgacttccccggcaagaccgtgtggttcgtgccgagcatcaagtccgggaacgacatcgcgaactgcctgcgcaagaacggcaagcgggtcatccagctcagccgcaagaccttcgacacggagtaccagaagaccaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgccgggccgatgcccgtcacggtggcgagcgccgcccagcgccggggccgcatcggccggaaccagaacaaggagggggaccagtacgtgtacatgggccagcccctgaacaacgacgaggaccacgcccactggaccgaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcctccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcgcggacgtactccgacccgctcgccctgcgcgagttcaaggagttcgccgccgggcggcgcagcgtcagcggcgacctgatcctcgagatcggcaagctgccccagcacctgaccctccgggcccagaacgcgctggacaacctggtgatgctccacaactccgagcagggcgggaaggcctaccgccacgccatggaggagctgcccgacaccatcgagaccctgatgctcctggccctgatcgcggtgctcaccggcggggtcaccctgttcttcctgagcgggaaggggctcggcaagacctccatcgggctgctgtgcgtgaccgccagctccgccctcctgtggatggccagcgtggagccccactggatcgccgcgtccatcatcctggagttcttcctcatggtcctgctgatcccggagcccgaccggcagcgcacgccccaggacaaccagctcgcctacgtggtgatcggcctgctgttcatgatcctcaccgtcgccgccaacgagatggggctgctggagaccaccaagaaggacctcggcatcgggcacgtggccgcggagaaccaccagcacgccacgatgctggacgtggacctgcggccggccagcgcctggaccctctacgccgtcgcgaccaccgtgatcacgcccatgatgcgccacaccatcgagaacaccaccgccaacatctccctgacggccatcgccaaccaggccgcgatcctgatgggcctcgacaagggctggcccatcagcaagatggacatcggggtgcccctgctggccctcggctgctactcccaggtcaacccgctgaccctgaccgccgccgtgctcatgctggtggcgcactacgccatcatcgggcccggcctgcaggccaaggccacccgggaggcccagaagcgcacggcggccgggatcatgaagaaccccaccgtcgacggcatcgtggccatcgacctcgaccccgtggtctacgacgccaagttcgagaagcagctgggccagatcatgctgctcatcctgtgcaccagccagatcctgctcatgcgcaccacgtgggccctgtgcgagtccatcaccctggcgaccgggccgctcaccacgctgtgggagggcagccccgggaagttctggaacaccaccatcgccgtgtccatggccaacatcttccggggcagctacctggccggcgccgggctcgcgttctccctgatgaagtccctgggcgggggccgccgggggaccggcgcccagggcgagacgctcggggagaagtggaagcgccagctgaaccagctgtccaagagcgagttcaacacctacaagcggagcggcatcatggaggtggaccgctccgaggccaaggaggggctcaagcggggcgagaccaccaagcacgccgtcagccgcgggaccgcgaagctgcggtggttcgtggagcgcaacctggtgaagcccgagggcaaggtcatcgacctgggctgcgggcggggcgggtggtcctactactgcgccggcctcaagaaggtgacggaggtgaaggggtacaccaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccacgatcgaggaggggcgcaccctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacccacgagatgtactgggtgagctgcggcacggggaacatcgtgtccgccgtcaacatgaccagccgcatgctcctgaaccggttcaccatggcccaccgcaagcccaccttcgagcgcgacgtggacctgggcgcgggcacgcggcacgtggccgtcgagcccgaggtggccaacctcgacatcatcgggcagcgcatcgagaacatcaagaacgagcacaagtccacctggcactacgacgaggacaacccgtacaagacctgggcctaccacggcagctacgaggtgaagccctccgggagcgcctccagcatggtcaacggcgtggtgcggctgctgaccaagccctgggacgtcatccccatggtgacgcagatcgcgatgaccgacaccaccccgttcgggcagcagcgcgtcttcaaggagaaggtggacacgcggacgccccgggccaagcggggcaccacccagatcatggaggtgacggccaagtggctctggggcttcctgtcccgcaacaagaagccccggatctgcacccgcgaggagttcacccggaaggtccgcagcaacgccgccatcggggcggtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggcgaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgccgacgacacggcggggtgggacacccggatcaccgaggacgacctccagaacgaggccaagatcaccgacatcatggagcccgagcacgccctgctggccacgagcatcttcaagctcacctaccagaacaaggtggtgcgcgtccagcgccccgccaagaacggcaccgtgatggacgtgatctcccggcgcgaccagcgggggagcggccaggtcggcacctacgggctgaacacgttcaccaacatggaggtgcagctgatccgccagatggagtccgagggcatcttcctccccagcgagctggagaccccgaacctggcggagcgggtgctcgactggctggagaagcacggggccgagcgcctgaagcggatggccatctccggcgacgactgcgtcgtgaagcccatcgacgaccgcttcgccaccgccctcaccgcgctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagacggcctgcctgggcaagagctacgcccagatgtggcagctcatgtacttccaccggcgcgacctgcggctggcggccaacgccatctgctccgccgtgcccgtcgactgggtgcccaccagccgcaccacctggagcatccacgcgcaccaccagtggatgacgaccgaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcaccgcccgcgccacgtgggccaccaacatccaggtcgccatcaaccaggtgcggcgcctgatcgggaacgagaactacctggactacatgacctccatgaagcggttcaagaacgagagcgaccccgagggcgcgctctggtga

SEQ ID NO: 8102 - RNA, 9879 nt, synthetic construct
  misc_feature 1..9879: note = derived and/or modified CDS sequence (opt1) from DENV-1__KJ189319__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctgttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcctggggtgcaagcccctcaccatgttcctgatcacggagaacaagatctggggccggaagtcctggcccctgaacgaggggatcatggccatcggcatcgtcagcatcctcctgtccagcctgctcaagaacgacgtgcccctggccgggccgctgatcgccggcggcatgctcatcgcctgctacgtgatcagcgggtccagcgcggacctgtccctggagaaggccgccgaggtcagctgggagcaggaggccgagcactccggcaccagccacaacatcctcgtggaggtgcaggacgacgggaccatgaagatcaaggacgaggagcgcgacgacaccctgacgatcctgctcaaggccaccctgctggcggtctccggcgtgtaccccatgagcatccccgccaccctcttcgtgtggtacttctggcagaagaagaagcagcggtccggggtcctgtgggacacccccagcccgcccgaggtggagcgcgccgtgctggacgacggcatctaccggatcctgcagcgcggcctcctggggcggtcccaggtcggcgtgggggtgttccaggacggcgtcttccacacgatgtggcacgtgacccgcggggccgtgctgatgtaccagggcaagcggctcgagcccagctgggcctccgtcaagaaggacctgatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctctacgggaacggcgtggtcacgaccagcgggacctacgtgtccgccatcgcccaggcgaaggccagccaggagggccccctgcccgagatcgaggacgaggtgttcaagaagcgcaacctgaccatcatggacctccacccggggagcggcaagacgcggcgctacctgcccgccatcgtccgggaggccatcaagcgcaagctgcggaccctcatcctggcgcccacccgcgtggtggcctccgagatggccgaggccctgaagggcatgcccatccgctaccagaccacggccgtcaagagcgagcacaccgggcgggagatcgtggacctcatgtgccacgcgaccttcaccatgcgcctgctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctccgcaagaacggcaagcgggtcatccagctgagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctcaaggacggccccgagcgggtgatcctggcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctcctggacaacatcaacacccccgaggggatcatcccggccctgttcgagcccgagcgcgagaagtccgccgccatcgacggcgagtaccgcctccgcggggaggcccgcaagaccttcgtcgagctgatgcggcgcggcgacctgcccgtgtggctcagctacaaggtcgcgtccgagggcttccagtacagcgaccggcgctggtgcttcgacggggagcggaacaaccaggtgctggaggagaacatggacgtggagatctggaccaaggagggcgagcgcaagaagctgcggccccgctggctcgacgcccggacctactccgacccgctggccctgcgcgagttcaaggagttcgccgccgggcggcgcagcgtcagcggcgacctcatcctggagatcggcaagctgccccagcacctcacgctgcgggcgcagaacgccctggacaacctcgtgatgctgcacaactccgagcagggcgggaaggcctaccgccacgccatggaggagctgcccgacaccatcgagaccctcatgctgctggcgctcatcgccgtgctgaccgggggcgtcacgctgttcttcctcagcgggaagggcctgggcaagacctccatcgggctgctctgcgtgaccgccagctccgccctgctgtggatggccagcgtggagccccactggatcgcggcctccatcatcctcgagttcttcctgatggtcctgctcatcccggagcccgaccggcagcgcacgccccaggacaaccagctggcctacgtggtgatcggcctcctcttcatgatcctgacggtcgccgccaacgagatggggctgctcgagaccaccaagaaggacctgggcatcgggcacgtggcggccgagaaccaccagcacgccaccatgctggacgtggacctccggccggccagcgcctggacgctgtacgcggtcgccaccaccgtgatcacccccatgatgcgccacacgatcgagaacaccaccgccaacatctccctgaccgccatcgccaaccaggcggccatcctcatgggcctggacaagggctggcccatcagcaagatggacatcggggtgcccctgctcgccctgggctgctactcccaggtcaacccgctgacgctcaccgccgcggtgctgatgctggtggcccactacgccatcatcgggcccggcctccaggccaaggccacccgggaggcgcagaagcgcaccgccgccgggatcatgaagaaccccacggtcgacggcatcgtggccatcgacctggaccccgtggtctacgacgccaagttcgagaagcagctgggccagatcatgctcctgatcctgtgcaccagccagatcctcctgatgcgcaccacctgggcgctgtgcgagtccatcacgctcgccaccgggccgctgaccaccctgtgggagggcagccccgggaagttctggaacacgaccatcgccgtgtccatggccaacatcttccggggcagctacctcgccggcgcggggctggccttctccctgatgaagtccctcggcgggggccgccgggggaccggcgcccagggcgagaccctgggggagaagtggaagcgccagctgaaccagctctccaagagcgagttcaacacgtacaagcggagcggcatcatggaggtggaccgctccgaggccaaggaggggctgaagcggggcgagaccaccaagcacgcggtcagccgcgggaccgccaagctgcggtggttcgtggagcgcaacctggtgaagcccgagggcaaggtcatcgacctcggctgcgggcggggcgggtggtcctactactgcgccggcctgaagaaggtgaccgaggtgaaggggtacacgaagggcggccccgggcacgaggagccgatccccatggccacctacggctggaacctggtcaagctccacagcgggaaggacgtgttcttcatgccgcccgagaagtgcgacaccctgctgtgcgacatcggcgagtccagcccgaaccccaccatcgaggaggggcgcacgctccgggtgctgaagatggtcgagccctggctgcgcggcaaccagttctgcatcaagatcctcaacccctacatgccgtccgtggtggagaccctggagcagatgcagcggaagcacggcgggatgctggtccgcaaccccctcagccggaactccacccacgagatgtactgggtgagctgcggcaccgggaacatcgtgtccgccgtcaacatgacgagccgcatgctgctgaaccggttcaccatggcgcaccgcaagcccaccttcgagcgcgacgtggacctcggcgccggcacccggcacgtggccgtcgagcccgaggtggccaacctggacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtcaacggcgtggtgcggctgctcaccaagccctgggacgtcatccccatggtgacccagatcgccatgacggacaccaccccgttcgggcagcagcgcgtcttcaaggagaaggtggacacccggacgccccgcgccaagcggggcaccacccagatcatggaggtgaccgccaagtggctgtggggcttcctgtcccgcaacaagaagccccggatctgcacgcgcgaggagttcacccggaaggtccgcagcaacgccgcgatcggggccgtgttcgtggacgagaaccagtggaacagcgccaaggaggccgtcgaggacgagcggttctgggacctcgtgcaccgcgagcgggagctgcacaagcagggcaagtgcgcgacctgcgtgtacaacatgatggggaagcgcgagaagaagctgggcgagttcgggaaggccaagggctcccgggccatctggtacatgtggctcggcgcccgcttcctggagttcgaggccctggggttcatgaacgaggaccactggttcagccgggagaactccctcagcggcgtcgagggggagggcctgcacaagctggggtacatcctccgcgacatctccaagatcccgggcggcaacatgtacgcggacgacaccgccgggtgggacacgcggatcaccgaggacgacctgcagaacgaggccaagatcaccgacatcatggagcccgagcacgccctgctcgccaccagcatcttcaagctgacgtaccagaacaaggtggtgcgcgtccagcgccccgcgaagaacggcaccgtgatggacgtgatctcccggcgcgaccagcgggggagcggccaggtcggcacctacgggctgaacaccttcacgaacatggaggtgcagctcatccgccagatggagtccgagggcatcttcctgcccagcgagctggagaccccgaacctcgccgagcgggtgctggactggctggagaagcacggggccgagcgcctcaagcggatggccatctccggcgacgactgcgtcgtgaagcccatcgacgaccgcttcgccaccgcgctgaccgccctgaacgacatggggaaggtgcggaaggacatcccccagtgggagcccagcaagggctggaacgactggcagcaggtcccgttctgctcccaccacttccaccagctcatcatgaaggacggccgcgagatcgtggtgccctgccggaaccaggacgagctggtcgggcgcgcccgggtgagccagggcgccgggtggtccctgcgcgagaccgcctgcctcggcaagagctacgcgcagatgtggcagctgatgtacttccaccggcgcgacctgcggctcgccgccaacgccatctgctccgcggtgcccgtcgactgggtgcccacgagccgcaccacctggagcatccacgcccaccaccagtggatgaccacggaggacatgctgtccgtgtggaaccgggtctggatcgaggagaacccgtggatggaggacaagacccacgtgagctcctgggaggaggtgccctacctggggaagcgcgaggaccagtggtgcggcagcctcatcggcctgaccgcccgcgccacctgggccacgaacatccaggtcgcgatcaaccaggtgcggcgcctgatcgggaacgagaactacctcgactacatgacctccatgaagcggttcaagaacgagagcgaccccgagggcgccctgtggtga

SEQ ID NO: 8103 - RNA, 9879 nt, synthetic construct
  misc_feature 1..9879: note = derived and/or modified CDS sequence (opt1) from DENV-1__KJ189320__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcaccgaggtggaccgctccgaggccaaggaggggctcaagcggggcgagaccaccaagcacgcggtcagccgcgggaccgccaagctgcggtggttcgtggagcgcaacctggtgaagcccgagggcaaggtcatcgacctgggctgcgggcggggcgggtggtcctactactgcgccggcctcaagaaggtgacggaggtgaaggggtacaccaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccacgatcgaggaggggcgcaccctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacccacgagatgtactgggtgagctgcggcacggggaacatcgtgtccgccgtcaacatgaccagccgcatgctcctgaaccggttcaccatggcgcaccgcaagcccaccttcgagcgcgacgtggacctgggcgccggcacgcggcacgtggccgtcgagcccgaggtggccaacctcgacatcatcgggcagcgcatcgagaacatcaagaacgagcacaagtccacctggcactacgacgaggacaacccgtacaagacctgggcctaccacggcagctacgaggtgaagccctccgggagcgcgtccagcatggtcaacggcgtggtgcggctgctgaccaagccctgggacgtcatccccatggtgacgcagatcgccatgaccgacaccaccccgttcgggcagcagcgcgtcttcaaggagaaggtggacacgcggacgccccgggccaagcggggcaccacccagatcatggaggtgacggccaagtggctctggggcttcctgtcccgcaacaagaagccccggatctgcacccgcgaggagttcacccggaaggtccgcagcaacgccgcgatcggggccgtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgcggacgacacggccgggtgggacacccggatcaccgaggacgacctccagaacgaggccaagatcaccgacatcatggagcccgagcacgccctgctggccacgagcatcttcaagctcacctaccagaacaaggtggtgcgcgtccagcgccccgcgaagaacggcaccgtgatggacgtgatctcccggcgcgaccagcgggggagcggccaggtcggcacctacgggctgaacacgttcaccaacatggaggtgcagctgatccgccagatggagtccgagggcatcttcctccccagcgagctggagaccccgaacctggccgagcgggtgctcgactggctggagaagcacggggccgagcgcctgaagcggatggccatctccggcgacgactgcgtcgtgaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagacggcctgcctgggcaagagctacgcgcagatgtggcagctcatgtacttccaccggcgcgacctgcggctggccgccaacgccatctgctccgcggtgcccgtcgactgggtgcccaccagccgcaccacctggagcatccacgcccaccaccagtggatgacgaccgaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcaccgcccgcgccacgtgggccaccaacatccaggtcgcgatcaaccaggtgcggcgcctgatcgggaacgagaactacctggactacatgacctccatgaagcggttcaagaacgagagcgaccccgagggcgccctctggtga

SEQ ID NO: 8104 - RNA, 9879 nt, synthetic construct
  misc_feature 1..9879: note = derived and/or modified CDS sequence (opt1) from DENV-1__KJ189323__SS-prME
  source 1..9879: mol_type = other RNA
agcgtgaccatgctgctcatgctgctgcccaccgccctcgccttccacctgaccacccggggcggggagccccacatgatcgtgtccaagcaggagcggggcaagagcctgctgttcaagacctccgccggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggcccttcaagctggagaaggaggtcgcggagacgcagcacggcaccgtgctggtgcaggtcaagtacgagggcaccgacgccccctgcaagatcccgttcagcacccaggacgagaagggggtgacgcagaacggccgcctcatcaccgccaaccccatcgtgaccgacaaggagaagcccgtcaacatcgagaccgagcccccgttcggggagtcctacatcgtggtgggcgccggcgagaaggcgctgaagctgagctggttcaagaaggggtccagcatcggcaagatgttcgaggccacggcccgcggggcccgccggatggccatcctcggcgacaccgcgtgggacttcgggtccatcggcggcgtcttcaccagcgtggggaagctggtgcaccaggtcttcggcaccgcctacggggtgctgttctccggcgtgagctggacgatgaagatcgggatcggcatcctcctgacctggctgggcctcaactcccgcagcacctccctgagcatgacctgcatcgccgtcgggatggtgacgctgtacctcggcgtgatggtccaggccgactccgggtgcgtgatcaactggaagggccgcgagctgaagtgcgggagcggcatcttcgtgaccaacgaggtccacacctggaccgagcagtacaagttccaggccgactcccccaagcggctgagcgcggccatcggcaaggcctgggaggagggggtgtgcggcatccgcagcgccacccggctcgagaacatcatgtggaagcagatctccaacgagctgaaccacatcctgctcgagaacgacatgaagttcacggtggtcgtgggggacgccaacggcatcctggcgcaggggaagaagatgatccgcccccagcccatggagcacaagtacagctggaagtcctggggcaaggccaagatcatcggcgccgacatccagaacaccaccttcatcatcgacgggccggacacccccgagtgccccgacaaccagcgggcctggaacatctgggaggtggaggactacggcttcgggatcttcacgaccaacatctggctgaagctccgcgacagctacacccagatgtgcgaccaccggctgatgtccgcggccatcaaggacagcaaggccgtccacgccgacatgggctactggatcgagtccgagaagaacgagacctggaagctggcccgcgcgagcttcatcgaggtgaagacgtgcacctggcccaagtcccacaccctctggagcaacggcgtgctggagtccgagatgatcatcccgaagatctacgggggccccatcagccagcacaactaccggcccgggtacttcacccagacggccggcccgtggcacctggggaagctcgagctggacttcgacctgtgcgagggcaccaccgtcgtggtggacgagcactgcggcaaccgcgggccctccctccggaccacgaccgtcaccggcaagatcatccacgagtggtgctgccgcagctgcaccctgccgcccctgcggttccgcggggaggacggctgctggtacgggatggagatccggccggtgaaggagaaggaggagaacctcgtgcgctccatggtcagcgccggctccggcgaggtggacagcttcagcctggggatcctgtgcgtgtccatcatgatcgaggaggtcatgcggagccgctggtcccggaagatgctcatgacgggcaccctggccgtgttcctgctcctggtgatggggcagctgacctggaacgacctcatccgcctgtgcatcatggtcggcgccaacgcgagcgaccgcatggggatgggcaccacgtacctggccctcatggccaccttcaagatgcggcccatgttcgccgtgggcctgctgttccgccggctcacctcccgcgaggtgctgctgctcaccatcgggctgagcctggtcgcctccgtggagctccccaacagcctggaggagctgggcgacgggctcgcgatgggcatcatgatgctgaagctgctcacggagttccagccccaccagctgtggaccaccctgctctccctgaccttcatcaagacgaccctgagcctcgactacgcctggaagaccaccgccatggccctgtccatcgtcagcctgttcccgctctgcctgtccacgaccagccagaagaccacctggctgcccgtgctcctgggctccttcgggtgcaagcccctgaccatgttcctcatcacggagaacaagatctggggccgcaagagctggcccctgaacgaggggatcatggcgatcggcatcgtgtccatcctgctcagctccctgctgaagaacgacgtcccgctcgccgggcccctgatcgccggcggcatgctgatcgcctgctacgtgatcagcgggagctccgccgacctcagcctggagaaggcggccgaggtgtcctgggagcaggaggccgagcacagcggcacctcccacaacatcctggtcgaggtgcaggacgacgggaccatgaagatcaaggacgaggagcgggacgacaccctcacgatcctgctgaaggccaccctcctggccgtgagcggcgtctaccccatgtccatccccgcgaccctgttcgtgtggtacttctggcagaagaagaagcagcggagcggggtgctctgggacaccccgagcccgcccgaggtcgagcgcgccgtgctggacgacggcatctaccggatcctgcagcgcggcctgctcgggcggagccaggtgggcgtcggggtgttccagggcggggtgttccacacgatgtggcacgtcacccgcggcgccgtgctgatgtaccagggcaagcggctggagccctcctgggccagcgtgaagaaggacctcatctcctacgggggcgggtggcgcttccagggcagctggaacaccggggaggaggtccaggtgatcgccgtggagccgggcaagaaccccaagaacgtccagaccacgcccggcaccttcaagacccccgagggggaggtgggcgcgatcgccctggacttcaagccggggacctccggcagccccatcgtgaaccgggagggcaagatcgtcgggctgtacggcaacggggtggtgacgacctccggcacctacgtcagcgccatcgcccaggccaaggcgtcccaggaggggcccctcccggagatcgaggacgaggtgttcaagaagcgcaacctgaccatcatggacctgcaccccggcagcggcaagacgcggcgctacctccccgccatcgtgcgggaggccatcaagcgcaagctgcggaccctgatcctcgcccccacccgcgtcgtggcgagcgagatggccgaggccctgaaggggatgccgatccgctaccagaccacggccgtgaagtccgagcacaccggccgggagatcgtcgacctgatgtgccacgccaccttcaccatgcgcctcctgagccccgtgcgggtgcccaactacaacatgatcatcatggacgaggcgcacttcacggaccccgcctccatcgccgcccgcgggtacatcagcacccgggtcggcatgggggaggccgcggccatcttcatgaccgccaccccgcccggctccgtggaggccttcccccagagcaacgccgtgatccaggacgaggagcgcgacatccccgagcggtcctggaacagcggctacgactggatcacggacttcccggggaagaccgtctggttcgtgccctccatcaagagcggcaacgacatcgcgaactgcctgcgcaagaacgggaagcgggtgatccagctctcccgcaagaccttcgacaccgagtaccagaagacgaagaacaacgactgggactacgtcgtgaccaccgacatcagcgagatgggcgccaacttccgggccgaccgcgtgatcgacccccggcgctgcctgaagcccgtcatcctgaaggacgggccggagcgggtgatcctcgccggccccatgcccgtgaccgtcgcgtccgccgcccagcgccggggccgcatcgggcggaaccagaacaaggagggcgaccagtacgtgtacatggggcagcccctgaacaacgacgaggaccacgcccactggacggaggccaagatgctgctcgacaacatcaacaccccggagggcatcatccccgcgctgttcgagcccgagcgcgagaagtccgccgccatcgacggggagtaccgcctgcggggcgaggcccgcaagaccttcgtcgagctcatgcggcgcggcgacctgcccgtgtggctgtcctacaaggtggccagcgaggggttccagtactccgaccggcgctggtgcttcgacggcgagcggaacaaccaggtcctcgaggagaacatggacgtggagatctggaccaaggagggggagcgcaagaagctgcggccgcgctggctggacgcgcggacctacagcgaccccctcgccctgcgcgagttcaaggagttcgccgccggccggcgctccgtgagcggcgacctgatcctcgagatcgggaagctgccccagcacctgacgctccgggcccagaacgcgctggacaacctggtcatgctccacaacagcgagcagggcgggaaggcctaccgccacgccatggaggagctgcccgacaccatcgagaccctgatgctcctggccctgatcgcggtgctcaccggcggggtgacgctgttcttcctgtccggcaagggcctcgggaagaccagcatcggcctgctgtgcgtcaccgcctccagcgccctcctgtggatggcctccgtggagccgcactggatcgccgcgagcatcatcctggagttcttcctcatggtgctgctgatccccgagcccgaccggcagcgcaccccgcaggacaaccagctcgcctacgtcgtgatcgggctgctgttcatgatcctcacggtggccgccaacgagatgggcctgctggagaccaccaagaaggacctcgggatcggccacgtcgccgcggagaaccaccagcacgccaccatgctggacgtggacctgcggcccgcctccgcctggacgctctacgccgtggcgaccaccgtcatcacccccatgatgcgccacacgatcgagaacaccaccgccaacatcagcctgaccgccatcgccaaccaggccgcgatcctgatgggcctcgacaaggggtggcccatctccaagatggacatcggcgtgccgctgctggccctcgggtgctacagccaggtgaaccccctgacgctgaccgccgccgtcctcatgctggtggcgcactacgccatcatcggccccgggctgcaggccaaggccacccgggaggcccagaagcgcaccgcggccggcatcatgaagaaccccacggtggacggcatcgtcgccatcgacctcgacccggtggtgtacgacgccaagttcgagaagcagctggggcagatcatgctgctcatcctgtgcacctcccagatcctgctcatgcgcaccacctgggccctgtgcgagagcatcacgctggcgaccggccccctcaccaccctgtgggaggggtcccccggcaagttctggaacacgaccatcgccgtcagcatggccaacatcttccggggctcctacctggccggggccggcctcgcgttcagcctgatgaagtccctcgggggcgggcgccgggggaccggcgcccagggggagaccctcggcgagaagtggaagcgccagctgaaccagctgagcaagtccgagttcaacacgtacaagcggagcgggatcatggaggtggaccgcagcgaggccaaggagggcctcaagcgcggggagaccaccaagcacgccgtgtcccgcggcaccgcgaagctgcggtggttcgtcgagcgcaacctggtgaagcccgagggcaaggtgatcgacctggggtgcggccgcgggggctggagctactactgcgccgggctcaagaaggtcaccgaggtgaagggctacacgaagggcgggccgggccacgaggagcccatccccatggccacctacgggtggaacctggtgaagctgcactccggcaaggacgtcttcttcatgcccccggagaagtgcgacaccctcctgtgcgacatcggggagagctcccccaaccccaccatcgaggagggccgcacgctgcgggtgctcaagatggtggagccctggctgcgcggcaaccagttctgcatcaagatcctgaacccgtacatgcccagcgtcgtggagaccctcgagcagatgcagcggaagcacgggggcatgctggtgcgcaaccccctgtcccggaacagcacccacgagatgtactgggtctcctgcgggaccggcaacatcgtgagcgccgtgaacatgacgtcccgcatgctcctgaaccggttcaccatggcccaccgcaagcccacctacgagcgcgacgtcgacctgggcgcggggacccggcacgtggccgtggagccggaggtcgccaacctcgacatcatcggccagcgcatcgagaacatcaagaacgagcacaagagcacgtggcactacgacgaggacaacccctacaagacctgggcctaccacgggtcctacgaggtgcggcccagcggctccgccagctccatggtgaacggggtcgtgcgcctgctgaccaagccctgggacgtcatcccgatggtgacccagatcgcgatgacggacaccacccccttcggccagcagcgggtgttcaaggagaaggtcgacacccgcacgccccgggccaagcgcggcaccacccagatcatggaggtgaccgccaagtggctctgggggttcctgagccggaacaagaagccgcgcatctgcacgcgggaggagttcacccgcaaggtgcggtccaacgccgccatcggcgcggtcttcgtggacgagaaccagtggaacagcgccaaggaggccgtggaggacgagcgcttctgggacctggtccaccgggagcgcgagctccacaagcaggggaagtgcgcgacctgcgtgtacaacatgatgggcaagcgggagaagaagctgggggagttcggcaaggcgaagggcagccgcgccatctggtacatgtggctgggggcccggttcctcgagttcgaggccctgggcttcatgaacgaggaccactggttctcccgcgagaacagcctgtccggggtggagggcgaggggctccacaagctgggctacatcctgcgggacatcagcaagatccccggcgggaacatgtacgccgacgacaccgcgggctgggacacgcgcatcaccgaggacgacctccagaacgaggccaagatcaccgagatcatggagcccgagcacgccctgctggccacctccatcttcaagctcacgtaccagaacaaggtcgtgcgcgtgcagcggcccgccaagaacgggaccgtcatggacgtgatcagccgccgggaccagcgcggctccggccaggtggggacctacggcctgaacaccttcacgaacatggaggtccagctgatccggcagatggagagcgaggggatcttcctcccgtccgagctggagacccccaacctggcggagcgcgtgctcgactggctggagaagcacggcgccgagcggctgaagcgcatggccatcagcggggacgactgcgtggtcaagcccatcgacgaccggttcgccaccgccctcaccgcgctgaacgacatgggcaaggtgcgcaaggacatcccccagtgggagccgtccaagggctggaacgactggcagcaggtccccttctgcagccaccacttccaccagctgatcatgaaggacgggcgggagatcgtcgtgccctgccgcaaccaggacgagctcgtgggccgggcccgcgtctcccagggggccggctggagcctgcgggagaccgcctgcctggggaagtcctacgcccagatgtggcagctcatgtacttccaccgccgggacctgcgcctggcggccaacgccatctgcagcgccgtgcccgtggactgggtcccgacgtcccggaccacctggagcatccacgcgcaccaccagtggatgaccacggaggacatgctcagcgtgtggaaccgcgtgtggatcgaggagaacccctggatggaggacaagacccacgtctccagctgggaggaggtgccctacctgggcaagcgcgaggaccagtggtgcggctccctgatcgggctcaccgcccgggccacctgggccacgaacatccaggtggccatcaaccaggtccgccggctgatcggcaacgagaactacctggactacatgaccagcatgaagcgcttcaagaacgagtccgaccccgagggggcgctctggtga

SEQ ID NO: 8105 - RNA, 9879 nt, synthetic construct
  misc_feature 1..9879: note = derived and/or modified CDS sequence (opt1) from DENV-1__KJ189324__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggggagctctgcgaggacaccatgacctacaagtgcccccagatcaccgaggccgagcccgacgacgtggactgctggtgcaacgccaccgacacctgggtgacctacgggacctgcagccagaccggggagcaccggcgggacaagcgctccgtggccctggcgccccacgtgggcctggggctcgagacgcggaccgagacctggatgagctccgagggcgcctggaagcagatccagcgggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggccccggagccacaccctctggtccaacggcgtgctggagagcgagatgatcatccccaagatctacgggggcccgatctcccagcacaactaccgccccgggtacttcacccagacggccggcccctggcacctggggaagctcgagctggacttcgacctgtgcgagggcaccaccgtcgtggtggacgagcactgcggcaaccgggggccgagcctccgcaccacgaccgtcaccggcaagatcatccacgagtggtgctgccggtcctgcaccctgccgcccctgcgcttccgcggggaggacggctgctggtacgggatggagatccgccccgtgaaggagaaggaggagaacctcgtgcggagcatggtctccgccggcagcggcgaggtggacagcttctccctggggatcctgtgcgccagcatcatgatcgaggaggtgatgcgctcccggtggagccgcaagatgctcatgacgggcaccctggccgtcttcctgctcctggtgatggggcagctgacctggaacgacctcatccgcctgtgcatcatggtgggcgcgaacgcctccgaccggatggggatgggcaccacgtacctggccctcatggccaccttcaagatgcgcccgatgttcgccgtcggcctgctgttccggcgcctcaccagccgggaggtgctgctgctcaccatcgggctgtccctggtggcgagcgtcgagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtgtccctgttccccctctgcctgagcacgacctcccagaagaccacctggctgccggtcctcctgggcagcttcgggtgcaagcccctgaccatgttcctcatcacggagaacaagatctggggccgcaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggtccagcgcggacctctccctggagaaggccgccgaggtgagctgggagcaggaggccgagcactccggcaccagccacaacatcctggtggaggtccaggacgacgggaccatgaagatcaaggacgaggagcgggacgacaccctcacgatcctgctgaaggccaccctcctggcggtgtccggcgtgtaccccatgagcatccccgccaccctgttcgtctggtacttctggcagaagaagaagcagcgctccggggtgctctgggacacccccagcccgcccgaggtggagcgggccgtcctggacgacggcatctaccgcatcctgcagcggggcctgctcgggcgctcccaggtgggcgtgggggtcttccaggacggcgtgttccacacgatgtggcacgtgacccgcggggccgtcctgatgtaccagggcaagcgcctggagcccagctgggcctccgtgaagaaggacctcatcagctacggcgggggctggcggttccaggggtcctggaacaccggcgaggaggtgcaggtcatcgcggtggagcccgggaagaacccgaagaacgtgcagaccacgcccggcaccttcaagacccccgagggcgaggtcggggccatcgccctggacttcaagcccggcaccagcgggtccccgatcgtgaaccgcgagggcaagatcgtgggcctgtacgggaacggcgtcgtgacgaccagcgggacctacgtgtccgccatcgcccaggcgaaggccagccaggagggccccctccccgagatcgaggacgaggtcttcaagaagcggaacctgaccatcatggacctgcacccggggagcggcaagacgcgccggtacctccccgccatcgtgcgcgaggccatcaagcggaagctgcgcaccctgatcctcgcgcccacccgcgtggtcgcctccgagatggccgaggccctgaagggcatgcccatccggtaccagaccacggccgtcaagagcgagcacaccgggcgcgagatcgtggacctgatgtgccacgcgaccttcaccatgcggctcctgtccccggtccgcgtgcccaactacaacatgatcatcatggacgaggcccacttcacggaccccgccagcatcgccgcccggggctacatctccacccgcgtggggatgggcgaggcggccgccatcttcatgaccgccacgccgcccgggagcgtcgaggccttcccccagtccaacgcggtgatccaggacgaggagcgggacatccccgagcgcagctggaactccggctacgactggatcacggacttccccggcaagaccgtgtggttcgtccccagcatcaagtccgggaacgacatcgccaactgcctgcggaagaacggcaagcgcgtgatccagctcagccggaagaccttcgacaccgagtaccagaagacgaagaacaacgactgggactacgtggtcaccaccgacatctccgagatgggggccaacttccgcgccgaccgggtgatcgacccccgccggtgcctgaagcccgtgatcctgaaggacggccccgagcgcgtcatcctcgcggggccgatgcccgtgaccgtggccagcgccgcccagcggcgcggccggatcggccgcaaccagaacaaggagggggaccagtacgtctacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccggctgcgcggggaggcccggaagaccttcgtggagctcatgcgccggggcgacctgcccgtctggctgagctacaaggtggcgtccgagggcttccagtacagcgaccgccggtggtgcttcgacggggagcgcaacaaccaggtgctcgaggagaacatggacgtcgagatctggaccaaggagggcgagcggaagaagctgcgcccccggtggctggacgcccgcacctactccgacccgctcgccctgcgggagttcaaggagttcgccgccgggcgccggagcgtgagcggcgacctgatcctcgagatcggcaagctgccccagcacctgacgctccgcgcgcagaacgccctggacaacctggtgatgctccacaactccgagcagggcgggaaggcctaccggcacgccatggaggagctgcccgacaccatcgagaccctgatgctcctggcgctgatcgccgtcctcaccgggggcgtgacgctgttcttcctgagcgggaagggcctcggcaagacctccatcgggctgctgtgcgtgaccgccagctccgccctcctgtggatggccagcgtcgagccccactggatcgcggcctccatcatcctggagttcttcctcatggtgctgctgatcccggagcccgaccgccagcggacgccccaggacaaccagctcgcctacgtggtcatcggcctgctgttcatgatcctcacggtggccgccaacgagatggggctgctggagaccaccaagaaggacctcggcatcgggcacgtggcggccgagaaccaccagcacgccaccatgctggacgtcgacctgcgcccggccagcgcctggacgctctacgcggtggccaccaccgtgatcacccccatgatgcggcacacgatcgagaacaccaccgccaacatctccctgaccgccatcgccaaccaggcggccatcctgatgggcctcgacaagggctggcccatcagcaagatggacatcggggtccccctgctggccctcggctgctactcccaggtgaacccgctgacgctgaccgccgcggtgctcatgctggtcgcccactacgccatcatcgggcccggcctgcaggccaaggccacccgcgaggcgcagaagcgcaccgccgccgggatcatgaagaaccccacggtggacggcatcgtggccatcgacctcgaccccgtcgtgtacgacgccaagttcgagaagcagctgggccagatcatgctgctcatcctgtgcaccagccagatcctgctcatgcggaccacctgggcgctgtgcgagtccatcacgctggccaccgggccgctcaccaccctgtgggagggcagccccgggaagttctggaacacgaccatcgccgtgtccatggccaacatcttccgcggcagctacctggccggcgcggggctcgccttctccctgatgaagtccctgggcgggggccggcgcgggaccggcgcccagggcgagaccctcggggagaagtggaagcggcagctgaaccagctgtccaagagcgagttcaacacgtacaagcgcagcggcatcatggaggtcgaccggtccgaggccaaggaggggctcaagcgcggcgagaccaccaagcacgcggtgagccgggggaccgccaagctgcgctggttcgtggagcggaacctggtcaagcccgagggcaaggtgatcgacctgggctgcgggcgcggcgggtggtcctactactgcgccggcctcaagaaggtgaccgaggtcaaggggtacacgaagggcggccccgggcacgaggagccgatccccatggccacctacggctggaacctggtgaagctgcacagcgggaaggacgtgttcttcatgccgcccgagaagtgcgacaccctcctgtgcgacatcggcgagtccagcccgaaccccaccatcgaggaggggcggacgctgcgcgtcctcaagatggtggagccctggctgcggggcaaccagttctgcatcaagatcctgaacccctacatgccgtccgtggtcgagaccctcgagcagatgcagcgcaagcacggcgggatgctggtgcggaaccccctgagccgcaactccacccacgagatgtactgggtgagctgcggcaccgggaacatcgtctccgccgtgaacatgacgagccggatgctcctgaaccgcttcaccatggcgcaccgcaagcccacctacgagcgggacgtggacctgggcgccggcacccgccacgtcgccgtggagcccgaggtggccaacctcgacatcatcgggcagcggatcgagaacatcaagaacgagcacaagtccacgtggcactacgacgaggacaacccgtacaagacctgggcctaccacggcagctacgaggtcaagccctccgggagcgcgtccagcatggtgaacggcgtggtccgcctgctgaccaagccctgggacgtgatccccatggtcacccagatcgccatgacggacaccaccccgttcgggcagcagcgggtgttcaaggagaaggtggacacccgcacgccccgggccaagcgcggcaccacccagatcatggaggtcaccgccaagtggctctggggcttcctgtcccggaacaagaagccccgcatctgcacgcgggaggagttcacccgcaaggtgcggagcaacgccgcgatcggggccgtgttcgtcgacgagaaccagtggaacagcgccaaggaggccgtggaggacgagcgcttctgggacctggtgcaccgggagcgcgagctccacaagcagggcaagtgcgcgacctgcgtctacaacatgatggggaagcgggagaagaagctgggcgagttcgggaaggccaagggctcccgcgccatctggtacatgtggctgggcgcccggttcctcgagttcgaggccctggggttcatgaacgaggaccactggttcagccgcgagaactccctgagcggcgtggagggggagggcctccacaagctggggtacatcctgcgggacatctccaagatcccgggcggcaacatgtacgcggacgacaccgccgggtgggacacgcgcatcaccgaggacgacctccagaacgaggccaagatcaccgagatcatggagcccgagcacgccctgctggccaccagcatcttcaagctcacgtaccagaacaaggtggtccgcgtgcagcggcccgcgaagaacggcaccgtgatggacgtcatctcccgccgggaccagcgcgggagcggccaggtgggcacctacgggctgaacaccttcacgaacatggaggtgcagctgatccggcagatggagtccgaggagatcttcctccccagcgagctggagaccccgaacctggccgagcgcgtcctcgactggctggagaagcacggcgccgagcggctgaagcgcatggccatctccggggacgactgcgtggtgaagcccatcgacgaccggttcgccaccgcgctcaccgccctgaacgacatgggcaaggtccgcaaggacatcccccagtgggagcccagcaaggggtggaacgactggcagcaggtcccgttctgctcccaccacttccaccagctgatcatgaaggacggccgggagatcgtggtcccctgccgcaaccaggacgagctcgtgggccgggcccgcgtgagccagggggccggctggtccctgcgggagaccgcctgcctgggcaagagctacgcgcagatgtggcagctcatgtacttccaccgccgggacctgcgcctggccgccaacgccatctgctccgcggtccccgtggactgggtgcccacgagccggaccacctggagcatccacgcccaccaccagtggatgaccacggaggacatgctctccgtctggaaccgcgtgtggatcgaggagaacccgtggatggaggacaagacccacgtgagctcctgggaggaggtcccctacctgggcaagcgcgaggaccagtggtgcgggagcctgatcggcctcaccgcccgggccacctgggccacgaacatccaggtggcgatcaaccaggtgcgccggctgatcggcaacgagaactacctggactacatgacctccatgaagcgcttcaagaacgagagcgaccccgagggggccctctggtga

SEQ ID NO: 8106 - RNA, 9879 nt, synthetic construct
  misc_feature 1..9879: note = derived and/or modified CDS sequence (opt1) from DENV-1__KJ189325__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggaccatcttcatcctgctgatgctcgtgacgccctccatggccatgcgctgcgtcggcatcggcaaccgggacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgcgatcctccgcaagctgtgcatcgaggccaagatcagcaacaccacgaccgactcccggtgcccgacccagggcgaggccaccctggtggaggagcaggacgccaacttcgtgtgccgccggacgttcgtcgaccgcggctgggggaacggctgcggcctcttcggcaaggggagcctgctgacctgcgccaagttcaagtgcgtgaccaagctcgagggcaagatcgtgcagtacgagaacctgaagtactccgtcatcgtgaccgtgcacacgggcgaccagcaccaggtcgggaacgagaccaccgagcacggcaccatcgcgaccatcacgccccaggcccccaccagcgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggacctccggggccagcaccagccaggagacgtggaaccgccaggacctcctggtgaccttcaagaccgcccacgcgaagaagcaggaggtggtcgtgctgggctcccaggagggcgccatgcacaccgccctcacgggggccaccgagatccagaccagcggcaccacgaccatcttcgccgggcacctgaagtgccggctgaagatggacaagctcaccctgaagggcacctcctacgtgatgtgcacggggagcttcaagctggagaaggaggtcgcggagacccagcacggcaccgtgctggtgcaggtcaagtacgagggcaccgacgccccctgcaagatccccttctccacgcaggacgagaagggggtgacccagaacggccgcctcatcaccgccaacccgatcgtgaccgacaaggagaagcccgtcaacatcgagacggagccgcccttcggggagagctacatcgtggtgggcgccggcgagaaggcgctgaagctgtcctggttcaagaaggggagctccatcggcaagatgttcgaggccaccgcccgcggggcccgccggatggccatcctcggcgacaccgcgtgggacttcgggagcatcggcggcgtcttcacctccgtggggaagctggtgcaccaggtcttcggcacggcctacggggtgctgttcagcggcgtgtcctggaccatgaagatcgggatcggcatcctcctgacctggctgggcctcaacagccgctccaccagcctgtccatgacgtgcatcgccgtcgggatggtgaccctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacgcggctcgagaacatcatgtggaagcagatcagcaacgagctgaaccacatcctgctcgagaacgacatgaagttcaccgtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacacgccggagtgccccgacaaccagcgggcctggaacatctgggaggtggaggactacggcttcgggatcttcaccaccaacatctggctgaagctccgcgactcctacacccagatgtgcgaccaccggctgatgagcgcggccatcaaggactccaaggccgtccacgccgacatgggctactggatcgagagcgagaagaacgagacgtggaagctggcccgcgcgtccttcatcgaggtgaagacctgcacctggcccaagagccacaccctctggtccaacggcgtgctggagagcgagatgatcatccccaagatctacgggggcccgatctcccagcacaactaccggcccgggtacttcacgcagaccgccggcccctggcacctggggaagctcgagctggacttcgacctgtgcgagggcaccaccgtcgtggtggacgagcactgcggcaaccgcgggccgagcctccggacgaccaccgtcaccggcaagatcatccacgagtggtgctgccgctcctgcacgctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgaccggcaccctggccgtcttcctgctcctggtgatggggcagctgacctggaacgacctcatccgcctgtgcatcatggtgggcgcgaacgcctccgaccgcatggggatgggcacgacctacctggccctcatggccaccttcaagatgcggccgatgttcgccgtcgggctgctgttccgccggctcaccagccgcgaggtgctgctgctcacgatcgggctgtccctggtggcgagcgtcgagctccccaactccctggaggagctgggcgacgggctcgccatgggcatcatgatgctgaagctgctcaccgagttccagccccaccagctgtggatcaccctgctcagcctgaccttcatcaagacgaccctgtccctcgactacgcctggaagaccaccgccatggcgctgagcatcgtgtccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggtccagcgcggacctctccctggagaaggccgccgaggtgagctgggagcaggaggccgagcactccggcaccagccacaacatcctggtggaggtccaggacgacgggaccatgaagatcaaggacgaggagcgcgacgacaccctcacgatcctgctgaaggccaccctcctggcggtgtccggcgtgtaccccatgagcatccccgccaccctgttcgtctggtacttctggcagaagaagaagcagcggtccggggtgctctgggacacccccagcccgcccgaggtggagcgcgccgtcctggacgacggcatctaccggatcctgcagcgcggcctgctcgggcggtcccaggtgggcgtgggggtcttccaggacggcgtgttccacacgatgtggcacgtgacccgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgcggtggagcccgggaagaacccgaagaacgtgcagaccatgcccggcacgttcaagacccccgagggcgaggtcggggccatcgccctggacttcaagcccggcaccagcgggtccccgatcgtgaaccgggagggcaagatcgtgggcctgtacgggaacggcgtcgtgaccacgagcgggacctacgtgtccgccatcgcccaggcgaaggccagccaggagggccccctccccgagatcgaggacgaggtcttcaagaagcgcaacctgaccatcatggacctgcacccggggagcggcaagacccggcgctacctccccgccatggtgcgggaggccatcaagcgcaagctgcggacgctgatcctcgcgcccacccgcgtggtcgcctccgagatggccgaggccctgaagggcatgcccatccgctaccagaccaccgccgtcaagagcgagcacacggggcgggagatcgtggacctgatgtgccacgcgaccttcaccatgcgcctcctgtccccggtccgggtgcccaactacaacatgatcatcatggacgaggcccacttcaccgaccccgccagcatcgccgcccgcggctacatctccacgcgggtggggatgggcgaggcggccgccatcttcatgaccgccacgccgcccgggagcgtcgaggccttcccccagtccaacgcggtgatccaggacgaggagcgcgacatccccgagcggagctggaactccggctacgactggatcaccgacttccccggcaagacggtgtggttcgtccccagcatcaagtccgggaacgacatcgccaactgcctgcgcaagaacggcaagcgggtgatccagctcagccgcaagaccttcgacaccgagtaccagaagaccaagaacaacgactgggactacgtggtcacgaccgacatctccgagatgggggccaacttccgggccgaccgcgtgatcgacccccggcgctgcctgaagcccgtgatcctgaaggacggccccgagcgggtcatcctcgcggggccgatgcccgtgaccgtggccagcgccgcccagcgccggggccgcatcggccggaaccagaacaaggagggggaccagtacgtctacatgggccagcccctgaacaacgacgaggaccacgcccactggaccgaggcgaagatgctgctcgacaacatcaacacgcccgaggggatcatcccggccctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcgtccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgaccctccgggcgcagaacgccctggacaacctggtgatgctccacaactccgagcagggcgggaaggcctaccgccacgccatggaggagctgcccgacacgatcgagaccctgatgctcctggcgctgatcgccgtcctcaccgggggcgtgaccctgttcttcctgagcgggaagggcctcggcaagacgtccatcgggctgctgtgcgtgaccgccagctccgccctcctgtggatggccagcgtcgagccccactggatcgcggcctccatcatcctggagttcttcctcatggtgctgctgatcccggagcccgaccggcagcgcacgccccaggacaaccagctcgcctacgtggtcatcggcctgctgttcatgatcctcaccgtggccgccaacgagatggggctgctggagacgaccaagaaggacctcggcatcgggcacgtggcggccgagaaccaccagcacgccaccatgctggacgtcgacctgcggccggccagcgcctggaccctctacgcggtggccacgaccgtgatcacccccatgatgcgccacaccatcgagaacacgaccgccaacatctccctgaccgccatcgccaaccaggcggccatcctgatgggcctcgacaagggctggcccatcagcaagatggacatcggggtccccctgctggccctcggctgctactcccaggtgaacccgctgaccctgacggccgcggtgctcatgctggtcgcccactacgccatcatcgggcccggcctgcaggccaaggccacccgggaggcgcagaagcgcaccgccgccgggatcatgaagaaccccaccgtggacggcatcgtggccatcgacctcgaccccgtcgtgtacgacgccaagttcgagaagcagctgggccagatcatgctgctcatcctgtgcacgagccagatcctgctcatgcgcaccacctgggcgctgtgcgagtccatcaccctggccacggggccgctcaccaccctgtgggagggcagccccgggaagttctggaacaccacgatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacctacaagcggagcggcatcatggaggtcgaccgctccgaggccaaggaggggctcaagcggggcgagacgaccaagcacgcggtgagccgcgggaccgccaagctgcggtggttcgtggagcgcaacctggtcaagcccgagggcaaggtgatcgacctgggctgcgggcggggcgggtggtcctactactgcgccggcctcaagaaggtgaccgaggtcaaggggtacaccaagggcggccccgggcacgaggagccgatccccatggccacgtacggctggaacctggtgaagctgcacagcgggaaggacgtgttcttcatgccgcccgagaagtgcgacaccctcctgtgcgacatcggcgagtccagcccgaaccccaccatcgaggaggggcgcaccctgcgggtcctcaagatggtggagccctggctgcgcggcaaccagttctgcatcaagatcctgaacccctacatgccgtccgtggtcgagacgctcgagcagatgcagcggaagcacggcgggatgctggtgcgcaaccccctgagccggaactccacccacgagatgtactgggtgagctgcggcaccgggaacatcgtctccgccgtgaacatgaccagccgcatgctcctgaaccggttcacgatggcgcaccgcaagcccacctacgagcgcgacgtggacctgggcgccggcacccggcacgtcgccgtggagcccgaggtggccaacctcgacatcatcgggcagcgcatcgagaacatcaagaacgagcacaagtccacctggcactacgacgaggacaacccgtacaagacgtgggcctaccacggcagctacgaggtcaagccctccgggagcgcgtccagcatggtgaacggcgtggtccggctgctgaccaagccctgggacgtgatccccatggtcacccagatcgccatgaccgacacgaccccgttcgggcagcagcgcgtgttcaaggagaaggtggacacccggacgccccgggccaagcggggcacgacccagatcatggaggtcaccgccaagtggctctggggcttcctgtcccgcaacaagaagccccggatctgcacccgcgaggagttcacgcggaaggtgcgcagcaacgccgcgatcggggccgtgttcgtcgacgagaaccagtggaacagcgccaaggaggccgtggaggacgagcggttctgggacctggtgcaccgcgagcgggagctccacaagcagggcaagtgcgcgacctgcgtctacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacaccgccgggtgggacacccggatcacggaggacgacctccagaacgaggccaagatcaccgagatcatggagcccgagcacgccctgctggccaccagcatcttcaagctcacctaccagaacaaggtggtccgcgtgcagcgccccgcgaagaacggcacggtgatggacgtcatctcccggcgcgaccagcgggggagcggccaggtgggcacctacgggctgaacaccttcaccaacatggaggtgcagctgatccgccagatggagtccgagggcatcttcctccccagcgagctggagacgccgaacctggccgagcgggtcctcgactggctggagaagcacggggccgagcgcctgaagcggatggccatctccggcgacgactgcgtggtgaagcccatcgacgaccgcttcgccaccgcgctcaccgccctgaacgacatggggaaggtccggaaggacatcccccagtgggagcccagcaagggctggaacgactggcagcaggtcccgttctgctcccaccacttccaccagctgatcatgaaggacggccgcgagatcgtggtcccctgccggaaccaggacgagctcgtggggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgctccgcggtccccgtggactgggtgcccaccagccgcacgacctggagcatccacgcccaccaccagtggatgaccaccgaggacatgctctccgtctggaaccgggtgtggatcgaggagaacccgtggatggaggacaagacgcacgtgagctcctgggaggaggtcccctacctggggaagcgcgaggaccagtggtgcggcagcctgatcggcctcaccgcccgcgccacctgggccaccaacatccaggtggcgatcaaccaggtgcggcgcctgatcgggaacgagaactacctggactacatgacgtccatgaagcggttcaagaacgagagcgaccccgagggcgccctctggtga

SEQ ID NO: 8107 - RNA, 9879 nt, synthetic construct
  misc_feature 1..9879: note = derived and/or modified CDS sequence (opt1) from DENV-1__KJ189326__SS-prME
  source 1..9879: mol_type = other RNA
agcgtgaccatgctgctcatgctgctgcccaccgccctcgccttccacctgacgacccggggcggggagccccacatgatcgtgagcaagcaggagcggggcaagagcctcctgttcaagaccagcgcgggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtcacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggaccatcttcatcctgctgatgctcgtgacgccctccatggccatgcgctgcgtcggcatcggcaaccgggacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgcgatcctccgcaagctgtgcatcgaggccaagatcagcaacaccacgaccgactcccggtgccccacccagggcgaggccaccctggtggaggagcaggacgccaacttcgtgtgccgccggacgttcgtcgaccgcggctgggggaacggctgcggcctgttcggcaaggggagcctgctgacctgcgccaagttcaagtgcgtgaccaagctcgagggcaagatcgtgcagtacgagaacctgaagtactccgtcatcgtgaccgtgcacacgggcgaccagcaccaggtcgggaacgagaccaccgagcacggcaccatcgcgaccatcacgccccaggcccccaccagcgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggacctccggggccagcaccagccaggagacgtggaaccgccaggacctcctggtgaccttcaagaccgcccacgcgaagaagcaggaggtggtcgtgctgggctcccaggagggcgccatgcacaccgccctcacgggggccaccgagatccagaccagcggcaccacgaccatcttcgccgggcacctgaagtgccggctgaagatggacaagctcaccctgaagggcacctcctacgtgatgtgcacggggagcttcaagctggagaaggaggtcgcggagacccagcacggcaccgtgctggtgcaggtcaagtacgagggcaccgacgccccctgcaagatccccttctccacgcaggacgagaagggggtgacccagaacggccgcctcatcaccgccaacccgatcgtgaccgacaaggagaagcccgtcaacatcgagacggagccgcccttcggggagagctacatcgtggtgggcgccggcgagaaggcgctgaagctgtcctggttcaagaaggggagctccatcggcaagatgttcgaggccaccgcccgcggggcccgccggatggccatcctcggcgacaccgcgtgggacttcgggagcatcggcggcgtcttcacctccgtggggaagctggtgcaccaggtcttcggcacggcctacggggtgctgttcagcggcgtgtcctggaccatgaagatcgggatcggcatcctcctgacctggctgggcctcaacagccgctccaccagcctgtccatgacgtgcatcgccgtcgggatggtgaccctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacgcggctcgagaacatcatgtggaagcagatcagcaacgagctgaaccacatcctgctcgagaacgacatgaagttcaccgtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacacgccggagtgccccgacaaccagcgggcctggaacatctgggaggtggaggactacggcttcgggatcttcaccaccaacatctggctgaagctccgcgactcctacacccagatgtgcgaccaccggctgatgagcgcggccatcaaggactccaaggccgtccacgccgacatgggctactggatcgagagcgagaagaacgagacgtggaagctggcccgcgcgtccttcatcgaggtgaagacctgcacctggcccaagagccacaccctctggtccaacggcgtgctggagagcgagatgatcatccccaagatctacgggggcccgatctcccagcacaactaccggcccgggtacttcacgcagaccgccggcccctggcacctggggaagctcgagctggacttcgacctgtgcgagggcaccaccgtcgtggtggacgagcactgcggcaaccgcgggccgagcctccggacgaccaccgtcaccggcaagatcatccacgagtggtgctgccgctcctgcacgctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgaccggcaccctggccgtcttcctgctcctggtgatggggcagctgacctggaacgacctcatccgcctgtgcatcatggtgggcgcgaacgcctccgaccgcatggggatgggcacgacctacctggccctcatggccaccttcaagatgcggccgatgttcgccgtcggcctgctgttccgccggctcaccagccgcgaggtgctgctgctcacgatcgggctgtccctggtggcgagcgtcgagctccccaactccctggaggagctgggcgacgggctcgccatgggcatcatgatgctgaagctgctcaccgagttccagccccaccagctgtggaccaccctgctcagcctgacgttcatcaagaccaccctgtccctcgactacgcctggaagaccacggccatggcgctgagcatcgtgtccctgttccccctctgcctgagcaccacctcccagaagaccacctggctgccggtcctcctgggcagcttcgggtgcaagcccctgacgatgttcctcatcaccgagaacaagatctggggccggaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggtccagcgcggacctctccctggagaaggccgccgaggtgagctgggagcaggaggccgagcactccggcaccagccacaacatcctggtggaggtccaggacgacgggaccatgaagatcaaggacgaggagcgcgacgacacgctcaccatcctgctgaaggccaccctcctggcggtgtccggcgtgtaccccatgagcatccccgccaccctgttcgtctggtacttctggcagaagaagaagcagcggtccggggtgctctgggacacgcccagcccgcccgaggtggagcgcgccgtcctggacgacggcatctaccggatcctgcagcgcggcctgctcgggcggtcccaggtgggcgtgggggtcttccaggacggcgtgttccacaccatgtggcacgtgacccgcggggccgtcctgatgtaccagggcaagcggctggagcccagctgggcctccgtgaagaaggacctcatcagctacggcgggggctggcgcttccaggggctgtggaacaccggcgaggaggtgcaggtcatcgcggtggagcccgggaagaacccgaagaacgtgcagacgacccccggcaccttcaagacccccgagggcgaggtcggggccatcgccctggacttcaagcccggcacgtccgggagcccgatcgtgaaccgggagggcaagatcgtgggcctctacgggaacggcgtcgtgaccacctccgggacctacgtgagcgccatcgcccaggcgaaggcctcccaggagggccccctgcccgagatcgaggacgaggtcttcaagaagcgcaacctgacgatcatggacctccacccggggagcggcaagacccggcgctacctgcccgccatggtgcgggaggccatcaagcgcaagctgcggaccctcatcctggcgcccacccgcgtggtcgccagcgagatggccgaggccctgaagggcatgcccatccgctaccagacgaccgccgtgaagtccgagcacaccgggcgggagatcgtggacctcatgtgccacgcgaccttcacgatgcgcctgctgagcccggtccgggtgcccaactacaacatgatcatcatggacgaggcccacttcaccgaccccgcctccatcgccgcccgcggctacatcagcacccgggtggggatgggcgaggcggccgccatcttcatgaccgccacgcccccggggtccgtcgaggccttcccccagagcaacgcggtgatccaggacgaggagcgcgacatccccgagcggtcctggaacagcggctacgactggatcaccgacttccccggcaagaccgtgtggttcgtcccgtccatcaagagcgggaacgacatcgccaactgcctccgcaagaacggcaagcgggtgatccagctgtcccgcaagaccttcgacacggagtaccagaagaccaagaacaacgactgggactacgtggtcaccaccgacatcagcgagatgggggccaacttccgggccgaccgcgtgatcgacccccggcgctgcctgaagcccgtgatcctcaaggacggccccgagcgggtcatcctggcggggccgatgcccgtgacggtggcctccgccgcccagcgccggggccgcatcggccggaaccagaacaaggagggggaccagtacgtctacatgggccagcccctgaacaacgacgaggaccacgcccactggaccgaggcgaagatgctcctggacaacatcaacacccccgaggggatcatcccggccctgttcgagcccgagcgcgagaagtccgccgccatcgacggcgagtaccgcctccgcggggaggcccgcaagaccttcgtggagctgatgcggcgcggcgacctgcccgtctggctctcctacaaggtggcgagcgagggcttccagtactccgaccggcgctggtgcttcgacggggagcggaacaaccaggtgctggaggagaacatggacgtcgagatctggaccaaggagggcgagcgcaagaagctgcggccccgctggctcgacgcccggacgtacagcgacccgctggccctgcgcgagttcaaggagttcgccgccgggcggcgctccgtgagcggcgacctcatcctggagatcggcaagctgccccagcacctcaccctgcgggcgcagaacgccctggacaacctcgtgatgctgcacaacagcgagcagggcgggaaggcctaccgccacgccatggaggagctgcccgacaccatcgagaccctcatgctgctggcgctcatcgccgtcctgaccggcggggtgaccctgttcttcctctccgggaaggggctgggcaagaccagcatcgggctgctctgcgtgaccgcctccagcgccctgctgtggatggcctccgtcgagccccactggatcgcggccagcatcatcctcgagttcttcctgatggtgctgctcatcccggagcccgaccggcagcgcacgccccaggacaaccagctggcctacgtggtcatcggcctcctcttcatgatcctgaccgtggccgccaacgagatggggctgctcgagaccaccaagaaggacctgggcatcgggcacgtggcggccgagaaccaccagcacgccacgatgctggacgtcgacctccggccggcctccgcctggaccctgtacgcggtggccaccaccgtgatcacgcccatgatgcgccacaccatcgagaacaccaccgccaacatcagcctgacggccatcgccaaccaggcggccatcctcatgggcctggacaagggctggcccatctccaagatggacatcggggtccccctgctcgccctgggctgctacagccaggtgaacccgctgaccctcaccgccgcggtgctgatgctggtcgcccactacgccatcatcgggcccggcctccaggccaaggccacccgggaggcgcagaagcgcacggccgccgggatcatgaagaaccccaccgtggacggcatcgtggccatcgacctggaccccgtcgtgtacgacgccaagttcgagaagcagctgggccagatcatgctcctgatcctgtgcacctcccagatcctcctgatgcgcaccacgtgggcgctgtgcgagagcatcaccctcgccaccgggccgctgaccacgctgtgggagggctcccccgggaagttctggaacaccaccatcgccgtgagcatggccaacatcttccggggctcctacctcgccggcgcggggctggccttcagcctgatgaagtccctcggcgggggccgccgggggaccggcgcccagggcgagacgctgggggagaagtggaagcgccagctgaaccagctcagcaagtccgagttcaacacctacaagcggagcggcatcatggaggtcgaccgcagcgaggccaaggaggggctgaagcggggcgagaccaccaagcacgcggtgtcccgcgggaccgccaagctgcggtggttcgtggagcgcaacctggtcaagcccgagggcaaggtgatcgacctcggctgcgggcggggcgggtggagctactactgcgccggcctgaagaaggtgacggaggtcaaggggtacaccaagggcggccccgggcacgaggagccgatccccatggccacctacggctggaacctggtgaagctccactccgggaaggacgtgttcttcatgccgcccgagaagtgcgacaccctgctgtgcgacatcggcgagagctccccgaaccccacgatcgaggaggggcgcaccctccgggtcctgaagatggtggagccctggctgcgcggcaaccagttctgcatcaagatcctcaacccctacatgccgagcgtggtcgagaccctggagcagatgcagcggaagcacggcgggatgctggtgcgcaaccccctctcccggaacagcacccacgagatgtactgggtgtcctgcggcacggggaacatcgtcagcgccgtgaacatgacctcccgcatgctgctgaaccggttcaccatggcgcaccgcaagcccacctacgagcgcgacgtggacctcggcgccggcacgcggcacgtcgccgtggagcccgaggtggccaacctggacatcatcgggcagcgcatcgagaacatcaagaacgagcacaagagcacctggcactacgacgaggacaacccgtacaagacctgggcctaccacggctcctacgaggtcaagcccagcgggtccgcgagctccatggtgaacggcgtggtccggctgctcaccaagccctgggacgtgatccccatggtcacgcagatcgccatgaccgacaccaccccgttcgggcagcagcgcgtgttcaaggagaaggtggacacgcggacgccccgggccaagcggggcaccacccagatcatggaggtcacggccaagtggctgtggggcttcctgagccgcaacaagaagccccggatctgcacccgcgaggagttcacccggaaggtgcgctccaacgccgcgatcggggccgtgttcgtcgacgagaaccagtggaacagcgccaaggaggccgtggaggacgagcggttctgggacctcgtgcaccgcgagcgggagctgcacaagcagggcaagtgcgcgacctgcgtctacaacatgatggggaagcgcgagaagaagctgggcgagttcgggaaggccaagggcagccgggccatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatcccgggcggcaacatgtacgcggacgacacggccgggtgggacacccggatcaccgaggacgacctgcagaacgaggccaagatcaccgagatcatggagcccgagcacgccctgctcgccacgtccatcttcaagctgacctaccagaacaaggtggtccgcgtgcagcgccccgcgaagaacggcaccgtgatggacgtcatcagccggcgcgaccagcgggggtccggccaggtgggcacctacgggctgaacacgttcaccaacatggaggtgcagctcatccgccagatggagagcgagggcatcttcctgccctccgagctggagaccccgaacctcgccgagcgggtcctggactggctggagaagcacggggccgagcgcctcaagcggatggccatcagcggcgacgactgcgtggtgaagcccatcgacgaccgcttcgccaccgcgctgaccgccctgaacgacatggggaaggtccggaaggacatcccccagtgggagccctccaagggctggaacgactggcagcaggtcccgttctgcagccaccacttccaccagctcatcatgaaggacggccgcgagatcgtggtcccctgccggaaccaggacgagctggtggggcgcgcccgggtgtcccagggcgccgggtggagcctgcgcgagacggcctgcctcggcaagtcctacgcgcagatgtggcagctgatgtacttccaccggcgcgacctgcggctcgccgccaacgccatctgcagcgcggtccccgtggactgggtgcccacctcccgcaccacctggagcatccacgcccaccaccagtggatgacgaccgaggacatgctgagcgtctggaaccgggtgtggatcgaggagaacccgtggatggaggacaagacccacgtgtccagctgggaggaggtcccctacctggggaagcgcgaggaccagtggtgcggctccctcatcggcctgaccgcccgcgccacgtgggccaccaacatccaggtggcgatcaaccaggtgcggcgcctgatcgggaacgagaactacctcgactacatgaccagcatgaagcggttcaagaacgagtccgaccccgagggcgccctgtggtga

SEQ ID NO: 8108 - RNA, 9879 nt, synthetic construct
  misc_feature 1..9879: note = derived and/or modified CDS sequence (opt1) from DENV-1__KJ189327__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtcacctacgggacctgcagccagaccggcgagcaccgccgggagaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacacccagaacaccaccttcatcatcgacgggcccgacacgccggagtgccccgacaaccagcgggcctggaacatctgggaggtggaggactacggcttcgggatcttcaccaccaacatctggctgaagctccgcgactcctacacccagatgtgcgaccaccggctgatgagcgcggccatcaaggactccaaggccgtccacgccgacatgggctactggatcgagagcgagaagaacgagacgtggaagctggcccgcgcgtccttcatcgaggtgaagacctgcacctggcccaagagccacaccctctggtccaacggcgtgctggagagcgagatgatcatccccaagatctacgggggcccgatctcccagcacaactaccggcccgggtacttcacgcagaccgccggcccctggcacctggggaagctcgagctggacttcgacctgtgcgagggcaccaccgtcgtggtggacgagcactgcggcaaccgcgggccgagcctccggacgaccaccgtcaccggcaagatcatccacgagtggtgctgccgctcctgcacgctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgaccggcaccctggccgtcttcctgctcctgatcatggggcagctgacctggaacgacctcatccgcctgtgcatcatggtgggcgcgaacgcctccgaccgcatggggatgggcacgacctacctggccctcatggccaccttcaagatgcggccgatgttcgccgtgggcctgctgttccgccggctcaccagccgcgaggtcctgctgctcacgatcgggctgtccctggtggcgagcgtggagctccccaactccctggaggagctgggcgacgggctcgccatgggcatcatgatgctgaagctgctcaccgagttccagccccaccagctgtggaccaccctgctcagcctgacgttcatcaagaccaccctgtccctcgactacgcctggaagaccacggccatggcgctgagcatcgtctccctgttccccctctgcctgagcaccacctcccagaagaccacctggctgccggtgctcctgggcagcttcgggtgcaagcccctgacgatgttcctcatcaccgagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacacgctcaccatcctgctgaaggccaccctcctggcggtctccggcgtgtaccccatgagcatccccgccaccctgttcgtgtggtacttctggcagaagaagaagcagcggtccggggtcctctgggacacgcccagcccgcccgaggtggagcgcgccgtgctggacgacggcatctaccggatcctgcagcgcggcctgctcgggcggtcccaggtcggcgtgggggtgttccaggacggcgtcttccacaccatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagacgacccccggcaccttcaagacccccgagggcgaggtgggggccatcgccctggacttcaagcccggcacgagcgggtccccgatcgtcaaccgggagggcaagatcgtgggcctgtacgggaacggcgtggtcaccaccagcgggacctacgtgtccgccatcgcccaggcgaaggccagccaggagggccccctccccgagatcgaggacgaggtgttcaagaagcgcaacctgacgatcatggacctgcacccggggagcggcaagacccggcgctacctccccgccatcgtccgggaggccatcaagcgcaagctgcggaccctgatcctcgcgcccacccgcgtggtggcctccgagatggccgaggccctgaagggcatgcccatccgctaccagacgaccgccgtcaagagcgagcacaccgggcgggagatcgtggacctgatgtgccacgcgaccttcacgatgcgcctcctgtccccggtgcgggtccccaactacaacatgatcatcatggacgaggcccacttcaccgaccccgccagcatcgccgcccgcggctacatctccacccgggtggggatgggcgaggcggccgccatcttcatgaccgccacgcccccggggagcgtggaggccttcccccagtccaacgcggtcatccaggacgaggagcgcgacatccccgagcggagctggaactccggctacgactggatcaccgacttccccggcaagaccgtgtggttcgtgccgagcatcaagtccgggaacgacatcgccaactgcctgcgcaagaacggcaagcgggtcatccagctcagccgcaagaccttcgacacggagtaccagaagaccaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcacggtggccagcgccgcccagcgccggggccgcatcggccggaaccagaacaaggagggggaccagtacgtgtacatgggccagcccctgaacaacgacgaggaccacgcccactggaccgaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacgtactccgacccgctcgccctgcgcgagttcaaggagttcgccgccgggcggcgcagcgtcagcggcgacctgatcctcgagatcggcaagctgccccagcacctgaccctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccggcggggtcaccctgttcttcctgagcgggaaggggctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcaccgtcgccgccaacgagatggggctgctggagaccaccaagaaggacctcggcatcgggcacgtggcggccgagaaccaccagcacgccacgatgctggacgtggacctgcggccggccagcgcctggaccctctacgcggtcgccaccaccgtgatcacgcccatgatgcgccacaccatcgagaacaccaccgccaacatctccctgacggccatcgccaaccaggcggccatcctgatgggcctcgacaagggctggcccatcagcaagatggacatcggggtgcccctgctggccctcggctgctactcccaggtcaacccgctgaccctgaccgccgcggtgctcatgctggtggcccactacgccatcatcgggcccggcctgcaggccaaggccacccgggaggcgcagaagcgcacggccgccgggatcatgaagaaccccaccgtcgacggcatcgtggccatcgacctcgaccccgtggtctacgacgccaagttcgagaagcagctgggccagatcatgctgctcatcctgtgcaccagccagatcctgctcatgcgcaccacgtgggcgctgtgcgagtccatcaccctggccaccgggccgctcaccacgctgtgggagggcagccccgggaagttctggaacaccaccatcgccgtgtccatggccaacatcttccggggcagctacctggccggcgcggggctcgccttctccctgatgaagtccctgggcgggggccgccgggggaccggcgcccagggcgagacgctcggggagaagtggaagcgccagctgaaccagctgtccaagagcgagttcaacacctacaagcggagcggcatcatggaggtggaccgctccgaggccaaggaggggctcaagcggggcgagaccaccaagcacgcggtcagccgcgggaccgccaagctgcggtggttcgtggagcgcaacctggtgaagcccgagggcaaggtcatcgacctgggctgcgggcggggcgggtggtcctactactgcgccggcctcaagaaggtgacggaggtgaaggggtacaccaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccacgatcgaggaggggcgcaccctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacccacgagatgtactgggtgagctgcggcacggggaacatcgtgtccgccgtcaacatgaccagccgcatgctcctgaaccggttcaccatggcgcaccgcaagcccaccttcgagcgcgacgtggacctgggcgccggcacgcggcacgtggccgtcgagcccgaggtggccaacctcgacatcatcgggcagcgcatcgagaacatcaagaacgagcacaagtccacctggcactacgacgaggacaacccgtacaagacctgggcctaccacggcagctacgaggtgaagccctccgggagcgcgtccagcatggtcaacggcgtggtgcggctgctgaccaagccctgggacgtcatccccatggtgacgcagatcgccatgaccgacaccaccccgttcgggcagcagcgcgtcttcaaggagaaggtggacacgcggacgccccgggccaagcggggcaccacccagatcatggaggtgacggccaagtggctctggggcttcctgtcccgcaacaagaagccccggatctgcacccgcgaggagttcacccggaaggtccgcagcaacgccgcgatcggggccgtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgcggacgacacggccgggtgggacacccggatcaccgaggacgacctccagaacgaggccaagatcaccgacatcatggagcccgagcacgccctgctggccacgagcatcttcaagctcacctaccagaacaaggtggtgcgcgtccagcgccccgcgaagaacggcaccgtgatggacgtgatctcccggcgcgaccagcgggggagcggccaggtcggcacctacgggctgaacacgttcaccaacatggaggtgcagctgatccgccagatggagtccgagggcatcttcctccccagcgagctggagaccccgaacctggccgagcgggtgctcgactggctggagaagcacggggccgagcgcctgaagcggatggccatctccggcgacgactgcgtcgtgaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagacggcctgcctgggcaagagctacgcgcagatgtggcagctcatgtacttccaccggcgcgacctgcggctggccgccaacgccatctgctccgcggtgcccgtcgactgggtgcccaccagccgcaccacctggagcatccacgcccaccaccagtggatgacgaccgaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcaccgcccgcgccacgtgggccaccaacatccaggtcgcgatcaaccaggtgcggcgcctgatcgggaacgagaactacctggactacatgacctccatgaagcggttcaagaacgagagcgaccccgagggcgccctctggtga

SEQ ID NO: 8109 - RNA, 9879 nt, synthetic construct
  misc_feature 1..9879: note = derived and/or modified CDS sequence (opt1) from DENV-1__KJ189328__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggagaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgtgagcatcatgatcgaggaggtcatgcggtcccgctggagccggaagatgctcatgacgggcaccctggccgtgttcctgctcctgatcatggggcagctgacctggaaggacctcatccgcctgtgcatcatggtgggcgccaacgcgtccgaccgcatggggatgggcaccacgtacctggccctcatggccaccttcaagatgcggccgatgttcgccgtcgggctgctgttccgccggctcaccagccgcgaggtgctgctgctcaccatcgggctgtccctggtggccagcgtcgagctccccaactccctggaggagctgggcgacgggctcgcgatgggcatcatgatgctgaagctgctcacggagttccacccccaccagctgtggaccaccctgctcagcctgaccttcatcaagacgaccctgtccctcgactacgcctggaagaccaccgccatggccctgagcatcgtgtccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggcgatcggcatcgtgagcatcctgctctccagcctgctgaagaacgacgtgcccctcgccgggccgctgatcgccggcggcatgctgatcgcctgctacgtcatcagcgggtccagcgccgacctctccctggagaaggcggccgaggtgagctgggagcaggaggccgagcactccggcaccagccacaacatcctggtggaggtccaggacgacgggaccatgaagatcaaggacgaggagcgcgacgacaccctcacgatcctgctgaaggccaccctcctggccgtgtccggcgtgtaccccatgagcatccccgcgaccctgttcgtctggtacttctggcagaagaagaagcagcggtccggggtgctctgggacacccccagcccgcccgaggtggagcgcgccgtcctggacgacggcatctaccggatcctgcagcgcggcctgctcgggcggtcccaggtgggcgtgggggtcttccaggacggcgtgttccacacgatgtggcacgtgacccgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgccgtggagcccgggaagaacccgaagaacgtgcagaccacgcccggcaccttcaagacccccgagggcgaggtcggggcgatcgccctggacttcaagcccggcaccagcgggtccccgatcgtgaaccgggagggcaagatcgtgggcctgtacgggaacggcgtcgtgacgaccagcgggacctacgtgtccgccatcgcccaggccaaggcgagccaggagggccccctccccgagatcgaggacgaggtcttcaagaagcgcaacctgaccatcatggacctgcacccggggagcggcaagacgcggcgctacctccccgccatcgtgcgggaggccatcaagcgcaagctgcggaccctgatcctcgcccccacccgcgtggtcgcgtccgagatggccgaggccctgaagggcatgcccatccgctaccagaccacggccgtcaagagcgagcacaccgggcgggagatcgtggacctgatgtgccacgccaccttcaccatgcgcctcctgtccccggtccgggtgcccaactacaacatgatcatcatggacgaggcgcacttcacggaccccgccagcatcgccgcccgcggctacatctccacccgggtggggatgggcgaggccgcggccatcttcatgaccgccacgccgcccgggagcgtcgaggccttcccccagtccaacgccgtgatccaggacgaggagcgcgacatccccgagcggagctggaactccggctacgactggatcacggacttccccggcaagaccgtgtggttcgtccccagcatcaagtccgggaacgacatcgcgaactgcctgcgcaagaacggcaagcgggtgatccagctcagccgcaagaccttcgacaccgagtaccagaagacgaagaacaacgactgggactacgtggtcaccaccgacatctccgagatgggggccaacttccgggccgaccgcgtgatcgacccccggcgctgcctgaagcccgtgatcctgaaggacggccccgagcgggtcatcctcgccgggccgatgcccgtgaccgtggcgagcgccgcccagcgccggggccgcatcggccggaaccagaacaaggagggggaccagtacgtctacatgggccagcccctgaacaacgacgaggaccacgcccactggacggaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcctccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcgcggacctactccgacccgctcgccctgcgcgagttcaaggagttcgccgccgggcggcgcagcgtgagcggcgacctgatcctcgagatcggcaagctgccccagcacctgacgctccgggcccagaacgcgctggacaacctggtgatgctccacaactccgagcagggcgggaaggcctaccgccacgccatcgaggagctgcccgacaccatcgagaccctgatgctcctggccctgatcgcggtcctcaccgggggcgtgacgctgttcttcctgagcgggaagggcctcggcaagacctccatcgggctgctgtgcgtgaccgccagctccgccctcctgtggatggccagcgtcgagccccactggatcgccgcgtccatcatcctggagttcttcctcatggtgctgctgatcccggagcccgaccggcagcgcacgccccaggacaaccagctcgcctacgtggtcatcggcctgctgttcatgatcctcacggtggccgccaacgagatggggctgctggagaccaccaagaaggacctcggcatcgggcacgtggccgcggagaaccaccagcacgccaccatgctggacgtcgacctgcggccggccagcgcctggacgctctacgccgtggcgaccaccgtgatcacccccatgatgcgccacacgatcgagaacaccaccgccaacatctccctgaccgccatcgccaaccaggccgcgatcctgatgggcctcgacaagggctggcccatcagcaagatggacatcggggtccccctgctggccctcggctgctactcccaggtgaacccgctgacgctgaccgccgccgtgctcatgctggtcgcgcactacgccatcatcgggcccggcctgcaggccaaggccacccgggaggcccagaagcgcaccgcggccgggatcatgaagaaccccacggtggacggcatcgtggccatcgacctcgaccccgtcgtgtacgacgccaagttcgagaagcagctgggccagatcatgctgctcatcctgtgcaccagccagatcctgctcatgcgcaccacctgggccctgtgcgagtccatcacgctggcgaccgggccgctcaccaccctgtgggagggcagccccgggaagttctggaacacgaccatcgccgtgtccatggccaacatcttccggggcagctacctggccggcgccgggctcgcgttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtcgaccgctccgaggccaaggaggggctcaagcggggcgagaccaccaagcacgccgtgagccgcgggaccgcgaagctgcggtggttcgtggagcgcaacctggtcaagcccgagggcaaggtgatcgacctgggctgcgggcggggcgggtggtcctactactgcgccggcctcaagaaggtgaccgaggtcaaggggtacacgaagggcggccccgggcacgaggagccgatccccatggccacctacggctggaacctggtgaagctgcacagcgggaaggacgtgttcttcatgccgcccgagaagtgcgacaccctcctgtgcgacatcggcgagtccagcccgaaccccaccatcgaggaggggcgcacgctgcgggtcctcaagatggtggagccctggctgcgcggcaaccagttctgcatcaagatcctgaacccctacatgccgtccgtggtcgagaccctcgagcagatgcagcggaagcacggcgggatgctggtgcgcaaccccctgagccggaactccacccacgagatgtactgggtgagctgcggcaccgggaacatcgtctccgccgtgaacatgacgagccgcatgctcctgaaccggttcaccatggcccaccgcaagcccacctacgagcgcgacgtggacctgggcgcgggcacccggcacgtcgccgtggagcccgaggtggccaacctcgacatcatcgggcagcgcatcgagaacatcaagaacgagcacaagtccacgtggcactacgacgaggacaacccgtacaagacctgggcctaccacggcagctacgaggtcaagccctccgggagcgcctccagcatggtgaacggcgtggtccggctgctgaccaagccctgggacgtgatccccatggtcacccagatcgcgatgacggacaccaccccgttcgggcagcagcgcgtgttcaaggagaaggtggacacccggacgccccgcgccaagcggggcaccacccagatcatggaggtcaccgccaagtggctctggggcttcctgtcccgcaacaagaagccccggatctgcacgcgcgaggagttcacccggaaggtgcgcagcaacgccgccatcggggcggtgttcgtcgacgagaaccagtggaacagcgccaaggaggccgtggaggacgagcggttctgggacctggtgcaccgcgagcgggagctccacaagcagggcaagtgcgcgacctgcgtctacaacatgatggggaagcgcgagaagaagctgggcgagttcgggaaggcgaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgccgacgacaccgcggggtgggacacgcggatcaccgaggacgacctccagaacgaggccaagatcaccgacatcatggagcccgagcacgccctgctggccaccagcatcttcaagctcacgtaccagaacaaggtggtccgcgtgcagcgccccgccaagaacggcaccgtgatggacgtcatctcccggcgcgaccagcgggggagcggccaggtgggcacctacgggctgaacaccttcacgaacatggaggtgcagctgatccgccagatggagtccgagggcatcttcctccccagcgagctggagaccccgaacctggcggagcgggtcctcgactggctggagaagcacggggccgagcgcctgaagcggatggccatctccggcgacgactgcgtggtgaagcccatcgacgaccgcttcgccaccgccctcaccgcgctgaacgacatggggaaggtccggaaggacatcccccagtgggagcccagcaagggctggaacgactggcagcaggtcccgttctgctcccaccacttccaccagctgatcatgaaggacggccgcgagatcgtggtcccctgccggaaccaggacgagctcgtggggcgcgcccgggtgagccagggcgccgggtggtccctgaaggagaccgcctgcctgggcaagagctacgcccagatgtggcagctcatgtacttccaccgccgggacctgcgcctggcggccaacgccatctgctccgccgtccccgtggactgggtgcccacgagccggaccacctggagcatccacgcgcaccaccagtggatgaccacggaggacatgctctccgtctggaaccgcgtgtggatcgaggagaacccgtggatggaggacaagacccacgtgagctcctgggaggaggtcccctacctggggaagcgggaggaccagtggtgcggcagcctgatcggcctcaccgcccgcgccacctgggccacgaacatccaggtggccatcaaccaggtgcgccggctgatcgggaacgagaactacctggactacatgacctccatgaagcgcttcaagaacgagagcgaccccgagggcgcgctctggtga

SEQ ID NO: 8110 - RNA, 9879 nt, synthetic construct
  misc_feature 1..9879: note = derived and/or modified CDS sequence (opt1) from DENV-1__KJ189329__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacgcctgggtcacctacgggacctgcagccagaccggcgagcaccggcgggacaagcgctccgtggcgctggcgccccacgtgggcctggggctcgagacccggacggagacctggatgagctccgagggcgcctggaagcagatccagcgggtcgagacctgggccctgcggcaccccgggttcaccgtgatcgccttcttcctggcccacgccatcggcacgagcatcacccagaaggggatcatcttcatcctcctgatgctggtgaccccctccatggccatgcgctgcgtcggcatcggcaaccgggacttcgtggaggggctcagcggcgccacctgggtggacgtcgtgctggagcacgggtcctgcgtgacgaccatggcgaagaacaagcccaccctggacatcgagctcctgaagaccgaggtcacgaaccccgccatcctgcgcaagctctgcatcgaggccaagatcagcaacaccaccaccgactcccggtgcccgacgcagggcgaggccaccctggtggaggagcaggacgccaacttcgtgtgccgccggaccttcgtcgaccgcggctgggggaacggctgcgggctgttcggcaaggggagcctcctgacctgcgcgaagttcaagtgcgtgacgaagctggagggcaagatcgtgcagtacgagaacctcaagtactccgtcatcgtgaccgtgcacaccggcgaccagcaccaggtcgggaacgagaccacggagcacggcaccatcgccaccatcacgccccaggcccccaccagcgagatccagctgacggactacggggccctgaccctcgactgcagcccccggaccggcctggacttcaacgagatggtgctgctcaccatgaaggagaagtcctggctggtccacaagcagtggttcctggacctcccgctgccctggacgtccggggccagcaccagccaggagacctggaaccgccaggacctgctcgtgaccttcaagacggcgcacgccaagaagcaggaggtggtcgtgctgggctcccaggagggcgccatgcacaccgccctgaccggggccaccgagatccagacgagcggcaccaccaccatcttcgcggggcacctcaagtgccggctgaagatggacaagctgacgctcaagggcacctcctacgtgatgtgcaccgggagcttcaagctggagaaggaggtcgccgagacccagcacggcacggtgctggtgcaggtcaagtacgagggcaccgacgccccctgcaagatccccttctccacccaggacgagaagggggtgacccagaacggccgcctgatcacggccaacccgatcgtgaccgacaaggagaagcccgtcaacatcgagaccgagccgcccttcggggagagctacatcgtggtgggcgcgggcgagaaggccctcaagctgtcctggttcaagaaggggagctccatcggcaagatgttcgaggccaccgcccgcggggcccgccggatggcgatcctgggcgacacggcctgggacttcgggagcatcggcggcgtcttcacctccgtggggaagctcgtgcaccaggtcttcggcaccgcctacggggtgctgttcagcggcgtgtcctggaccatgaagatcgggatcggcatcctgctcacgtggctgggcctgaacagccgctccaccagcctctccatgacctgcatcgccgtcgggatggtgaccctgtacctgggcgtgatggtccaggccgacagcgggtgcgtgatcaactggaagggccgcgagctcaagtgcgggtccggcatcttcgtgacgaacgaggtccacacctggaccgagcagtacaagttccaggcggacagcccgaagcggctgagcgccgccatcggcaaggcctgggaggagggggtgtgcggcatccgctccgccacccggctggagaacatcatgtggaagcagatcagcaacgagctcaaccacatcctgctggagaacgacatgaagttcaccgtggtcgtgggggacgcgaacggcatcctcgcccaggggaagaagatgatccgcccccagcccatggagcacaagtactcctggaagtcctggggcaaggccaagatcatcggcgccgacatccagaacacgaccttcatcatcgacgggcccgacaccccggagtgccccgacaaccagcgggcgtggaacatctgggaggtggaggactacggcttcgggatcttcaccacgaacatctggctgaagctgcgcgactcctacacccagatgtgcgaccaccggctcatgagcgccgccatcaaggactccaaggccgtccacgccgacatgggctactggatcgagagcgagaagaacgagacctggaagctggcgcgcgcctccttcatcgaggtgaagacctgcacgtggcccaagagccacaccctgtggtccaacggcgtgctcgagagcgagatgatcatccccaagatctacgggggcccgatctcccagcacaactaccggagcgggtacttcacccagaccgccggcccctggcacctggggaagctggagctcgacttcgacctgtgcgagggcacgaccgtcgtggtggacgagcactgcggcaaccgcgggccctccctgcggaccaccacggtcaccggcaagatcatccacgagtggtgctgccgcagctgcaccctcccgcccctgcggttccgcggggaggacggctgctggtacgggatggagatccggcccgtgaaggagaaggaggagaacctggtgcgctccatggtcagcgccggcagcggcgaggtggactccttcagcctcgggatcctgtgcgcctccatcatgatcgaggaggtgatgcggagccgctggtcccggaagatgctgatgaccggcacgctcgcggtcttcctgctgctcgtgatggggcagctgacctggaacgacctgatccgcctctgcatcatggtgggcgccaacgccagcgaccgcatggggatgggcaccacctacctggccctgatggccacgttcaagatgcggcccatgttcgcggtcggcctcctgttccgccggctgacctcccgcgaggtgctcctgctgaccatcgggctcagcctggtggcctccgtcgagctgccgaacagcctcgaggagctgggcgacgggctggccatgggcatcatgatgctcaagctgctgaccgagttccagccccaccagctctggacgaccctgctgtccctcaccttcatcaagaccacgctgagcctggactacgcctggaagaccaccgcgatggccctctccatcgtgagcctgttccccctgtgcctctccaccacgagccagaagaccacctggctgcccgtcctgctcggctccttcgggtgcaagccgctgaccatgttcctgatcaccgagaacaagatctggggccgcaagagctggcccctcaacgaggggatcatggccatcggcatcgtgtccatcctgctgagcagcctcctgaagaacgacgtgcccctggccgggcccctcatcgccggcggcatgctgatcgcgtgctacgtcatctccgggagctccgccgacctgagcctcgagaaggccgccgaggtgtcctgggagcaggaggccgagcacagcggcacgtcccacaacatcctggtggaggtccaggacgacgggaccatgaagatcaaggacgaggagcgcgacgacaccctgaccatcctcctgaaggcgacgctgctcgccgtgagcggcgtgtacccgatgtccatccccgccaccctgttcgtctggtacttctggcagaagaagaagcagcggagcggggtgctgtgggacacccccagcccgcccgaggtggagcgcgccgtcctcgacgacggcatctaccggatcctgcagcgcggcctgctggggcggagccaggtgggcgtgggggtcttccaggacggcgtgttccacaccatgtggcacgtgacgcgcggggccgtcctcatgtaccagggcaagcggctggagccctcctgggcgagcgtgaagaaggacctgatctcctacggcgggggctggcgcttccaggggagctggaacaccggcgaggaggtgcaggtcatcgccgtggagcccgggaagaaccccaagaacgtgcagaccacccccggcacgttcaagacccccgagggcgaggtcggggccatcgccctcgacttcaagcccggcacctccgggagccccatcgtgaaccgggagggcaagatcgtgggcctgtacgggaacggcgtcgtgaccacgtccgggacctacgtgagcgccatcgcgcaggccaaggccagccaggagggcccgctgcccgagatcgaggacgaggtcttcaagaagcgcaacctcaccatcatggacctgcaccccgggtccggcaagacccggcgctacctgccggccatcgtgcgggaggcgatcaagcgcaagctccggacgctgatcctggcccccacccgcgtggtcgccagcgagatggccgaggccctcaagggcatgcccatccgctaccagaccaccgcggtgaagtccgagcacacggggcgggagatcgtggacctgatgtgccacgccaccttcaccatgcgcctgctcagccccgtccgggtgccgaactacaacatgatcatcatggacgaggcccacttcaccgaccccgcctccatcgccgcgcgcggctacatcagcacgcgggtggggatgggcgaggccgccgccatcttcatgaccgccacgccgcccgggtccgtcgaggcgttcccgcagagcaacgccgtgatccaggacgaggagcgcgacatccccgagcggtcctggaacagcggctacgactggatcaccgacttccccggcaagacggtgtggttcgtcccctccatcaagagcgggaacgacatcgccaactgcctgcgcaagaacggcaagcgggtgatccagctgtcccgcaagaccttcgacaccgagtaccagaagaccaagaacaacgactgggactacgtggtcacgaccgacatcagcgagatgggggccaacttccgggcggaccgcgtgatcgacccgcggcgctgcctcaagcccgtgatcctgaaggacggccccgagcgggtcatcctggccgggcccatgccggtgaccgtggcctccgccgcccagcgccggggccgcatcggccggaaccagaacaaggagggggaccagtacgtctacatgggccagcccctcaacaacgacgaggaccacgcgcactggaccgaggccaagatgctgctggacaacatcaacacgcccgaggggatcatccccgccctcttcgagccggagcgcgagaagtccgccgccatcgacggcgagtaccgcctgcgcggggaggcgcgcaagaccttcgtggagctgatgcggcgcggcgacctccccgtctggctgtcctacaaggtggccagcgagggcttccagtactccgaccggcgctggtgcttcgacggggagcggaacaaccaggtgctggaggagaacatggacgtcgagatctggaccaaggagggcgagcgcaagaagctccggccccgctggctggacgcccggacctacagcgaccccctggccctccgcgagttcaaggagttcgccgcggggcggcgcagcgtgtccggcgacctgatcctggagatcggcaagctcccgcagcacctgaccagccgggcccagaacgccctggacaacctcgtgatgctgcacaactccgagcagggcgggaaggcctaccgccacgcgatggaggagctgcccgacacgatcgagaccctcatgctgctggccctcatcgccgtcctgaccgggggcgtgaccctgttcttcctcagcgggaagggcctgggcaagacgtccatcgggctgctctgcgtgaccgccagctccgccctgctgtggatggcgagcgtcgagccccactggatcgccgcctccatcatcctcgagttcttcctgatggtgctgctcatccccgagccggaccggcagcgcacgccccaggacaaccagctggcctacgtggtcatcggcctcctgttcatgatcctgaccgtggccgcgaacgagatggggctgctcgagacgaccaagaaggacctgggcatcgggcacgtggccgccgagaaccaccagcacgccaccatgctggacgtcgacctccggcccgccagcgcgtggaccctgtacgccgtggccacgaccgtgatcaccccgatgatgcgccacaccatcgagaacacgaccgccaacatctccctgaccgccatcgcgaaccaggccgccatcctcatgggcctggacaagggctggcccatcagcaagatggacatcggggtccccctgctcgccctgggctgctactcccaggtgaaccccctgaccctcacggcggccgtgctgatgctggtcgcccactacgccatcatcgggccgggcctccaggccaaggcgacccgggaggcccagaagcgcaccgccgccgggatcatgaagaaccccaccgtggacggcatcgtggccatcgacctggaccccgtcgtgtacgacgcgaagttcgagaagcagctgggccagatcatgctcctgatcctgtgcacgagccagatcctcctgatgcgcaccacctgggccctgtgcgagtccatcaccctcgccacggggcccctgaccaccctgtgggagggcagcccggggaagttctggaacaccacgatcgccgtgtccatggccaacatcttccggggcagctacctcgcgggcgccgggctggccttctccctgatgaagtccctcggcgggggccgccgggggaccggcgcccagggcgagaccctgggggagaagtggaagcgccagctgaaccagctcagcaagtccgagttcaacacctacaagcggagcggcatcatggaggtcgaccgctccgaggcgaaggaggggctgaagcggggcgagacgaccaagcacgccgtgagccgcgggaccgccaagctgcggtggttcgtggagcgcaacctcgtcaagcccgagggcaaggtgatcgacctgggctgcgggcggggcgggtggtcctactactgcgccggcctgaagaaggtgaccgaggtcaaggggtacaccaagggcggccccgggcacgaggagcccatcccgatggccacgtacggctggaacctggtgaagctccacagcgggaaggacgtgttcttcatgccgcccgagaagtgcgacaccctgctgtgcgacatcggcgagtccagccccaacccgaccatcgaggaggggcgcaccctccgggtcctgaagatggtggagccctggctgcgcggcaaccagttctgcatcaagatcctcaacccctacatgccctccgtggtcgagacgctggagcagatgcagcggaagcacggcgggatgctggtgcgcaacccgctcagccggaactccacccacgagatgtactgggtgagctgcggcaccgggaacatcgtctccgcggtgaacatgaccagccgcatgctgctgaaccggttcacgatggcccaccgcaagcccacctacgagcgcgacgtggacctcggcgccggcacccggcacgtcgccgtggagcccgaggtggccaacctggacatcatcgggcagcgcatcgagaacatcaagaacgagcacaagtccacctggcactacgacgaggacaacccctaccggacgtgggcgtaccacggcagctacgaggtcaagccgtccgggagcgcctccagcatggtgaacggcgtggtccgcctgctcaccaagccctgggacgtgatccccatggtcacccagatcgccatgaccgacacgacccccttcgggcagcagcgggtgttcaaggagaaggtggacacccgcaccccgcgggccaagcgcggcacgacccagatcatggaggtcaccgccaagtggctgtggggcttcctgagccggaacaagaagccccgcatctgcacccgggaggagttcacgcgcaaggtgcggtccaacgcggccatcggggccgtgttcgtcgacgagaaccagtggaacagcgccaaggaggcggtggaggacgagcgcttctgggacctcgtgcaccgggagcgcgagctgcacaagcagggcaagtgcgcgacctgcgtctacaacatgatggggaagcgggagaagaagctgggcgagttcgggaaggccaagggctcccgcgccatctggtacatgtggctcggcgcccggttcctggagttcgaggcgctggggttcatgaacgaggaccactggttcagccgcgagaactccctcagcggcgtggagggggagggcctgcacaagctggggtacatcctccgggacatctccaagatccccggcggcaacatgtacgccgacgacaccgccgggtgggacacccgcatcacggaggacgacctgcagaacgaggccaagatcaccgagatcatggagccggagcacgccctgctcgcgaccagcatcttcaagctgacctaccagaacaaggtggtccgcgtgcagcggcccgccaagaacggcacggtgatggacgtcatctcccgccgggaccagcgcgggagcggccaggtgggcacctacgggctgaacaccttcaccaacatggaggtgcagctcatccggcagatggagtccgagggcatcttcctgcccagcgagctggagacgcccaacctcgccgagcgcgtcctggactggctggagaagcacggggccgagcggctcaagcgcatggccatctccggcgacgactgcgtggtgaagccgatcgacgaccggttcgcgaccgccctgaccgccctgaacgacatggggaaggtccgcaaggacatcccccagtgggagcccagcaagggctggaacgactggcagcaggtccccttctgctcccaccacttccaccagctcatcatgaaggacggccgggagatcgtggtcccgtgccgcaaccaggacgagctggtggggcgggcccgcgtgagccagggcgccgggtggtccctgcgggagaccgcgtgcctcggcaagagctacgcccagatgtggcagctgatgtacttccaccgccgggacctgcgcctcgccgccaacgcgatctgcagcgccgtccccgtggactgggtgcccacctcccggacgacctggagcatccacgcccaccaccagtggatgaccaccgaggacatgctgtccgtctggaaccgcgtgtggatcgaggagaacccctggatggaggacaagacgcacgtgagctcctgggaggaggtcccgtacctggggaagcgcgaggaccagtggtgcggcagcctcatcggcctgaccgcccgggccacctgggcgaccaacatccaggtggccatcaaccaggtgcgccggctgatcgggaacgagaactacctcgactacatgacgtccatgaagcgcttcaagaacgagagcgaccccgagggcgccctgtggtga

SEQ ID NO: 8111 - RNA, 9879 nt, synthetic construct
  misc_feature 1..9879: note = derived and/or modified CDS sequence (opt1) from DENV-1__KJ189331__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgatcggcacgctggccgtcttcctgctcctgatcatggggcagctgacctggaacgacctcatccgcctgtgcatcatggtgggcgcgaacgcctccgaccgcatggggatgggcaccacctacctggccctcatggccacgttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcaccgagttccagccccaccagctgtggacgaccctgctcagcctgaccttcatcaagaccacgctgtccctcgactacgcctggaagaccaccgccatggcgctgagcatcgtctccctgttccccctctgcctgagcaccacgtcccagaagaccacctggctgccggtgctcctgggcagcttcgggtgcaagcccctgaccatgttcctcatcaccgagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaagacggccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggccgtctccggcgtgtaccccatgagcatccccgcgaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgccgtcgagcccgggaagaacccgaagaacgtgcagaccacgcccggcaccttcaagacccccgagggcgaggtgggggcgatcgccctggacttcaagcccggcaccagcgggtccccgatcgtcaaccgggagggcaagatcgtgggcctgtacgggaacggcgtggtcacgaccagcgggacctacgtgtccgccatcgcccaggccaaggcgagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcccccacccgcgtggtggcgtccgagatggccgaggccctgaagggcatgcccatccgctaccagaccacggccgtcaagagcgagcacaccgggcgggagatcgtggacctgatgtgccacgccaccttcaccatgcgcctcctgtccccggtgcgggtccccaactacaacatgatcatcatggacgaggcgcacttcacggaccccgccagcatcgccgcccgcggctacatctccacccgggtggggatgggcgaggccgcggccatcttcatgaccgccacgccgcccgggagcgtggaggccttcccccagtccaacgccgtcatccaggacgaggagcgcgacatccccgagcggagctggaactccggctacgactggatcacggacttccccggcaagaccgtgtggttcgtgcccagcatcaagtccgggaacgacatcgcgaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgccgggccgatgcccgtcaccgtggcgagcgccgcccagcgccggggccgcatcggccggaaccagaacaaggagggggaccagtacgtgtacatgggccagcccctgaacaacgacgaggaccacgcccactggacggaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcctccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcgcggacctactccgacccgctcgccctgcgcgagttcaaggagttcgccgccgggcggcgcagcgtcagcggcgacctgatcctcgagatcggcaagctgccccagcacctgacgctccgggcccagaacgcgctggacaacctggccatgctccacaactccgagcagggcgggaaggcctaccgccacgccatggaggagctgcccgacaccatcgagaccctgatgctcctggcgctgatcgccgtgctcaccgggggcgtgacgctgttcttcctgagcgggaagggcctcggcaagacctccatcgggctgctgtgcgtcaccgccagctccgccctcctgtggatggccagcgtggagccccactggatcgcggcctccatcatcctggagttcttcctcatggtgctgctgatcccggagcccgaccggcagcgcacgccccaggacaaccagctcgcctacgtcgtgatcggcctgctgttcatgatcctcacggtggccgccaacgagatggggctgctggagaccaccaagaaggacctcggcatcgggcacgtcgcggccgagaaccaccagcacgccaccatgctggacgtggacctgcggccggccagcgcctggacgctctacgcggtggccaccaccgtcatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtgaacccgctgacgctgaccgccgcggtcctcatgctggtggcccactacgccatcatcgggcccggcctgcaggccaaggccacccgggaggcgcagaagcgcaccgccgccgggatcatgaagaaccccacggtggacggcatcgtcgccatcgacctcgaccccgtggtgtacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtctccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgcggtgagccgcgggaccgccaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacacgaagggcggccccgggcacgaggagccgatccccatggccacctacggctggaacctggtgaagctgcacagcgggaaggacgtcttcttcatgccgcccgagaagtgcgacaccctcctgtgcgacatcggcgagtccagcccgaaccccaccatcgaggaggggcgcacgctgcgggtgctcaagatggtggagccctggctgcgcggcaaccagttctgcatcaagatcctgaacccctacatgccgtccgtcgtggagaccctcgagcagatgcagcggaagcacggcgggatgctggtgcgcaaccccctgagccggaactccacccacgagatgtactgggtcagctgcggcaccgggaacatcgtgtccgccgtgaacatgacgagccgcatgctcctgaaccggttcaccatggcgcaccgcaagcccaccttcgagcgcgacgtcgacctgggcgccggcacccggcacgtggccgtggagcccgaggtcgccaacctcgacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtgaacggcgtcgtgcggctgctgaccaagccctgggacgtgatccccatggtcacccagatcgccatgacggacaccaccccgttcgggcagcagcgcgtgttcaaggagaaggtcgacacccggacgccccgcgccaagcggggcaccacccagatcatggaggtgaccgccaagtggctctggggcttcctgtcccgcaacaagaagccccggatctgcacgcgcgaggagttcacccggaaggtgcgcagcaacgccgcgatcggggccgtcttcgtggacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacaccgccgggtgggacacgcggatcaccgaggacgacctccagaacgaggccaagatcaccgacatcatggagcccgagcacgccctgctggccaccagcatcttcaagctcacgtaccagaacaaggtcgtgcgcgtgcagcgccccgcgaagaacggcaccgtcatggacgtgatctcccggcgcgaccagcgggggagcggccaggtgggcacctacgggctgaacaccttcacgaacatggaggtccagctgatccgccagatggagtccgagggcatcttcctccccagcgagctggagaccccgaacctggccgagcgggtgctcgactggctggagaagcacggggccgagcgcctgaagcggatggccatctccggcgacgactgcgtggtcaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctcgtggggcgcgcccgggtcagccagggcgccgggtggtccctgcgcgagaccgcctgcctgggcaagagctacgcgcagatgtggcagctcatgtacttccaccggcgcgacctgcggctggccgccaacgccatctgctccgcggtgcccgtggactgggtccccacgagccgcaccacctggagcatccacgcccaccaccagtggatgaccacggaggacatgctctccgtgtggaaccgggtgtggatcgaggagaacccgtggatggaggacaagacccacgtcagctcctgggaggaggtgccctacctggggaagcgcgaggaccagtggtgcggcagcctgatcggcctcaccgcccgcgccacctgggccacgaacatccaggtggcgatcaaccaggtccggcgcctgatcgggaacgagaactacctggactacatgacctccatgaagcggttcaagaacgagagcgaccccgagggcgccctctggtga

SEQ ID NO: 8112 - RNA, 9879 nt, synthetic construct
  misc_feature 1..9879: note = derived and/or modified CDS sequence (opt1) from DENV-1__KJ189332__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggaccatcttcatcctgctgatgctcgtgacgccctccatggccatgcgctgcgtcggcatcggcaaccgggacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgcgatcctccgcaagctgtgcatcgaggccaagatcagcaacaccacgaccgactcccggtgcccgacccagggcgaggccaccctggtggaggagcaggacgccaacttcgtgtgccgccggacgttcgtcgaccgcggctgggggaacggctgcggcctcttcggcaaggggagcctgctgacctgcgccaagttcaagtgcgtgaccaagctcgagggcaagatcgtgcagtacgagaacctgaagtactccgtcatcgtgaccgtgcacacgggcgaccagcaccaggtcgggaacgagaccaccgagcacggcaccatcgcgaccatcacgccccaggcccccaccagcgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggacctccggggccagcaccagccaggagacgtggaaccgccaggacctcctggtgaccttcaagaccgcccacgcgaagaagcaggaggtggtcgtgctgggctcccaggagggcgccatgcacaccgccctcacgggggccaccgagatccagaccagcggcaccacgaccatcttcgccgggcacctgaagtgccggctgaagatggacaagctcaccctgaagggcacctcctacgtgatgtgcacggggagcttcaagctggagaaggaggtcgcggagacccagcacggcaccgtgctggtgcaggtcaagtacgagggcaccgacgccccctgcaagatccccttctccacgcaggacgagaagggggtgacccagaacggccgcctcatcaccgccaacccgatcgtgaccgacaaggagaagcccgtcaacatcgagacggagccgcccttcggggagagctacatcgtggtgggcgccggcgagaaggcgctgaagctgtcctggttcaagaaggggagctccatcggcaagatgttcgaggccaccgcccgcggggcccgccggatggccatcctcggcgacaccgcgtgggacttcgggagcatcggcggcgtcttcacctccgtggggaagctggtgcaccaggtcttcggcacggcctacggggtgctgttcagcggcgtgtcctggaccatgaagatcgggatcggcatcctcctgacctggctgggcctcaacagccgctccaccagcctgtccatgacgtgcatcgccgtcgggatggtgaccctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacgcggctcgagaacatcatgtggaagcagatcagcaacgagctgaaccacatcctgctcgagaacgacatgaagttcaccgtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacacgccggagtgccccgacaaccagcgggcctggaacatctgggaggtggaggactacggcttcgggatcttcaccaccaacatctggctgaagctccgcgactcctacacccagatgtgcgaccaccggctgatgagcgcggccatcaaggactccaaggccgtccacgccgacatgggctactggatcgagagcgagaagaacgagacgtggaagctggcccgcgcgtccttcatcgaggtgaagacctgcacctggcccaagagccacaccctctggtccaacggcgtgctggagagcgagatgatcatccccaagatctacgggggcccgatctcccagcacaactaccggcccgggtacttcacgcagaccgccggcccctggcacctggggaagctcgagctggacttcgacctgtgcgagggcaccaccgtcgtggtggacgagcactgcggcaaccgcgggccgagcctccggacgaccaccgtcaccggcaagatcatccacgagtggtgctgccgctcctgcacgctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgaccggcaccctggccgtcttcctgctcctgatcatggggcagctgacctggaacgacctcatccgcctgtgcatcatggtgggcgcgaacgcctccgaccgcatggggatgggcacgacctacctggccctcatggccaccttcaagatgcggccgatgttcgccgtggggctgctgttccgccggctcaccagccgcgaggtcctgctgctcacgatcgggctgtccctggtggcgagcgtggagctccccaactccctggaggagctgggcgacgggctcgccatgggcatcatgatgctgaagctgctcaccgagttccagccccaccagctgtggaccaccctgctcagcctgacgttcatcaagaccaccctgtccctcgactacgcctggaagaccacggccatggcgctgagcatcgtctccctgttccccctctgcctgagcaccacctcccagaagaccacctggctgccggtgctcctgggcagcttcgggtgcaagcccctgacgatgttcctcatcaccgagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaagaccgccgaggtcagctgggagcaggaggccgagcactccggcaccagccacaacatcctggtggaggtgcaggacgacgggacgatgaagatcaaggacgaggagcgcgacgacaccctcaccatcctgctgaaggccaccctcctggccgtctccggcgtgtaccccatgagcatccccgcgacgctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacaccatgtggcacgtgacccgcggggccgtgctgatgtaccagggcaagcggctggagcccagctgggcctccgtcaagaaggacctcatcagctacggcgggggctggcgcttccaggggtcctggaacacgggcgaggaggtccaggtgatcgccgtcgagcccgggaagaacccgaagaacgtgcagaccacccccggcaccttcaagacgcccgagggcgaggtgggggcgatcgccctggacttcaagcccggcaccagcgggtccccgatcgtcaaccgggagggcaagatcgtgggcctgtacgggaacggcgtggtcaccaccagcgggacgtacgtgtccgccatcgcccaggccaaggcgagccaggagggccccctccccgagatcgaggacgaggtgttcaagaagcgcaacctgaccatcatggacctgcacccggggagcggcaagacccggcgctacctccccgccatcgtccgggaggccatcaagcgcaagctgcggaccctgatcctcgcccccacgcgcgtggtggcgtccgagatggccgaggccctgaagggcatgcccatccgctaccagaccaccgccgtcaagagcgagcacaccgggcgggagatcgtggacctgatgtgccacgccacgttcaccatgcgcctcctgtccccggtgcgggtccccaactacaacatgatcatcatggacgaggcgcacttcaccgaccccgccagcatcgccgcccgcggctacatctccacccgggtggggatgggcgaggccgcggccatcttcatgacggccacgccgcccgggagcgtggaggccttcccccagtccaacgccgtcatccaggacgaggagcgcgacatccccgagcggagctggaactccggctacgactggatcaccgacttccccggcaagaccgtgtggttcgtgcccagcatcaagtccgggaacgacatcgcgaactgcctgcgcaagaacggcaagcgggtcatccagctcagccgcaagacgttcgacaccgagtaccagaagaccaagaacaacgactgggactacgtggtgaccacggacatctccgagatgggggccaacttccgggccgaccgcgtcatcgacccccggcgctgcctgaagcccgtgatcctgaaggacggccccgagcgggtgatcctcgccgggccgatgcccgtcaccgtggcgagcgccgcccagcgccggggccgcatcggccggaaccagaacaaggagggggaccagtacgtgtacatgggccagcccctgaacaacgacgaggaccacgcccactggaccgaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcctccgagggcttccagtacagcgaccggcgctggtgcttcgacggggagcggaacaaccaggtgctcgaggagaacatggacgtggagatctggacgaaggagggcgagcgcaagaagctgcggccccgctggctggacgcgcggacctactccgacccgctcgccctgcgcgagttcaaggagttcgccgccgggcggcgcagcgtcagcggcgacctgatcctcgagatcggcaagctgccccagcacctgaccctccgggcccagaacgcgctggacaacctggccatgctccacaactccgagcagggcgggaaggcctaccgccacgccatggaggagctgcccgacaccatcgagacgctgatgctcctggcgctgatcgccgtgctcaccgggggcgtgaccctgttcttcctgagcgggaagggcctcggcaagacctccatcgggctgctgtgcgtcacggccagctccgccctcctgtggatggccagcgtggagccccactggatcgcggcctccatcatcctggagttcttcctcatggtgctgctgatcccggagcccgaccggcagcgcacgccccaggacaaccagctcgcctacgtcgtgatcggcctgctgttcatgatcctcaccgtggccgccaacgagatggggctgctggagaccacgaagaaggacctcggcatcgggcacgtcgcggccgagaaccaccagcacgccaccatgctggacgtggacctgcggccggccagcgcctggaccctctacgcggtggccaccacggtcatcacccccatgatgcgccacaccatcgagaacaccacggccaacatctccctgaccgccatcgccaaccaggcggccatcctgatgggcctcgacaagggctggcccatcagcaagatggacatcggggtgcccctgctggccctcggctgctactcccaggtgaacccgctgaccctgaccgccgcggtcctcatgctggtggcccactacgccatcatcgggcccggcctgcaggccaaggccacgcgggaggcgcagaagcgcaccgccgccgggatcatgaagaaccccaccgtggacggcatcgtcgccatcgacctcgaccccgtggtgtacgacgccaagttcgagaagcagctgggccagatcatgctgctcatcctgtgcaccagccagatcctgctcatgcgcacgacctgggcgctgtgcgagtccatcaccctggccaccgggccgctcacgaccctgtgggagggcagccccgggaagttctggaacaccaccatcgccgtctccatggccaacatcttccggggcagctacctggccggcgcggggctcgccttctccctgatgaagtccctgggcgggggccgccgggggacgggcgcccagggcgagaccctcggggagaagtggaagcgccagctgaaccagctgtccaagagcgagttcaacacctacaagcggagcggcatcatggaggtggaccgctccgaggccaaggaggggctcaagcggggcgagaccaccaagcacgcggtgagccgcgggacggccaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacaccaagggcggccccgggcacgaggagccgatccccatggccacctacggctggaacctggtgaagctgcacagcgggaaggacgtcttcttcatgccgcccgagaagtgcgacacgctcctgtgcgacatcggcgagtccagcccgaaccccaccatcgaggaggggcgcaccctgcgggtgctcaagatggtggagccctggctgcgcggcaaccagttctgcatcaagatcctgaacccctacatgccgtccgtcgtggagaccctcgagcagatgcagcggaagcacggcgggatgctggtgcgcaaccccctgagccggaactccacgcacgagatgtactgggtcagctgcggcaccgggaacatcgtgtccgccgtgaacatgaccagccgcatgctcctgaaccggttcaccatggcgcaccgcaagcccacgttcgagcgcgacgtcgacctgggcgccggcacccggcacgtggccgtggagcccgaggtcgccaacctcgacatcatcgggcagcgcatcgagaacatcaagaacgagcacaagtccacctggcactacgacgaggacaacccgtacaagacctgggcctaccacggcagctacgaggtgaagccctccgggagcgcgtccagcatggtgaacggcgtcgtgcggctgctgacgaagccctgggacgtgatccccatggtcacccagatcgccatgaccgacaccacgccgttcgggcagcagcgcgtgttcaaggagaaggtcgacacccggacgccccgggccaagcggggcaccacgcagatcatggaggtgaccgccaagtggctctggggcttcctgtcccgcaacaagaagccccggatctgcacccgcgaggagttcacccggaaggtgcgcagcaacgccgcgatcggggccgtcttcgtggacgagaaccagtggaacagcgccaaggaggccgtggaggacgagcggttctgggacctggtccaccgcgagcgggagctccacaagcagggcaagtgcgcgacgtgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacaccgccgggtgggacacccggatcaccgaggacgacctccagaacgaggccaagatcacggacatcatggagcccgagcacgccctgctggccaccagcatcttcaagctcacctaccagaacaaggtcgtgcgcgtgcagcgccccgcgaagaacggcaccgtcatggacgtgatctcccggcgcgaccagcgggggagcggccaggtgggcacgtacgggctgaacaccttcaccaacatggaggtccagctgatccgccagatggagtccgagggcatcttcctccccagcgagctggagaccccgaacctggccgagcgggtgctcgactggctggagaagcacggggccgagcgcctgaagcggatggccatctccggcgacgactgcgtggtcaagcccatcgacgaccgcttcgccaccgcgctcacggccctgaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctcgtggggcgcgcccgggtcagccagggcgccgggtggtccctgcgcgagaccgcctgcctgggcaagagctacgcgcagatgtggcagctcatgtacttccaccggcgcgacctgcggctggccgccaacgccatctgctccgcggtgcccgtggactgggtccccaccagccgcaccacgtggagcatccacgcccaccaccagtggatgaccaccgaggacatgctctccgtgtggaaccgggtgtggatcgaggagaacccgtggatggaggacaagacccacgtcagctcctgggaggaggtgccctacctggggaagcgcgaggaccagtggtgcggcagcctgatcggcctcacggcccgcgccacctgggccaccaacatccaggtggcgatcaaccaggtccggcgcctgatcgggaacgagaactacctggactacatgacctccatgaagcggttcaagaacgagagcgaccccgagggcgccctctggtga

SEQ ID NO: 8113 - RNA, 9879 nt, synthetic construct
  misc_feature 1..9879: note = derived and/or modified CDS sequence (opt1) from DENV-1__KJ189334__SS-prME
  source 1..9879: mol_type = other RNA
agcgtgaccatgctgctcatgctgctgcccaccgccctcgccttccacctgaccacccggggcggggagccgcacatgatcgtgagcaagcaggagcggggcaagagcctcctcttcaaggtgtccgcgggggtgaacatgtgcaccctgatcgccatggacctgggcgagctctgcgaggacaccatgacctacaagtgcccccagatcaccgaggccgagcccgacgacgtcgactgctggtgcaacgccaccgacacctgggtgacctacgggacctgcagccagaccggcgagcaccgccgggacaagcgctccgtggccctggcgccccacgtcggcctggggctcgagacccggaccgagacctggatgagctccgagggcgcctggaagcagatccagcgcgtggagacctgggccctgcggcaccccgggttcaccgtgatcgccttcttcctggcgcacgccatcggcacgagcatcacccagaaggggatcatcttcatcctcctgatgctggtcaccccctccatggccatgcgctgcgtgggcatcggcaaccgggacttcgtggaggggctcagcggcgccacctgggtcgacgtggtgctggagcacgggtcctgcgtcacgaccatggccaagaacaagcccaccctggacatcgagctcctgaagaccgaggtgacgaaccccgcgatcctgcgcaagctctgcatcgaggccaagatcagcaacaccaccaccgactcccggtgccccacgcagggcgaggccaccctggtggaggagcaggacgccaacttcgtctgccgccggaccttcgtggaccgcggctgggggaacggctgcgggctgttcggcaaggggagcctcctgacctgcgccaagttcaagtgcgtgacgaagctggagggcaagatcgtccagtacgagaacctcaagtactccgtgatcgtgaccgtccacaccggcgaccagcaccaggtggggaacgagaccacggagcacggcaccatcgcgaccatcacgccccaggcccccaccagcgagatccagctgacggactacggggccctgaccctcgactgcagcccccggaccggcctggacttcaacgagatggtcctgctcaccatgaaggagaagtcctggctggtgcacaagcagtggttcctggacctcccgctgccctggacgtccggggccagcaccagccaggagacctggaaccgccaggacctgctcgtgaccttcaagacggcccacgcgaagaagcaggaggtcgtggtgctgggctcccaggagggcgccatgcacaccgccctgaccggggccaccgagatccagacgagcggcaccaccaccatcttcgccgggcacctcaagtgccggctgaagatggacaagctgacgctcaagggcacctcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctgatcacggccaacccgatcgtcaccgacaaggagaagcccgtgaacatcgagaccgagccgcccttcggggagagctacatcgtggtcggcgccggcgagaaggcgctcaagctgtcctggttcaagaaggggagctccatcggcaagatgttcgaggccaccgcccgcggggcgcgccggatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacaaccagcgggcctggaacatctgggaggtcgaggactacggcttcgggatcttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtgaagacctgcacgtggcccaagagccacaccctgtggtccaacggcgtcctcgagagcgagatgatcatccccaagatctacgggggcccgatctcccagcacaactaccggcccgggtacttcacccagaccgccggcccctggcacctggggaagctggagctcgacttcgacctgtgcgagggcacgaccgtggtggtcgacgagcactgcggcaaccgcgggccgagcctgcggaccaccacggtgaccggcaagatcatccacgagtggtgctgccgctcctgcaccctgccgcccctgcggttccgcggggaggacggctgctggtacgggatggagatccggcccgtgaaggagaaggaggagaacctggtccgcagcatggtgtccgccggcagcggcgaggtggacagcttctccctcgggatcctgtgcgtcagcatcatgatcgaggaggtgatgcggtcccgctggagccggaagatgctgatgaccggcacgctcgccgtgttcctgctgctcgtcatggggcagctgacctggaacgacctgatccgcctctgcatcatggtgggcgccaacgcgtccgaccgcatggggatgggcaccacctacctggccctgatggccacgttcaagatgcggccgatgttcgccgtgggcctcctgttccgccggctgaccagccgcgaggtcctcctgctgaccatcgggctctccctggtggccagcgtcgagctgcccaactccctcgaggagctgggcgacgggctggcgatgggcatcatgatgctcaagctgctgaccgagttccagccccaccagctctggacgaccctgctgagcctcaccttcatcaagaccacgctgtccctggactacgcctggaagaccaccgccatggccctcagcatcgtgtccctgttccccctgtgcctcagcaccacgtcccagaagaccacctggctgccggtgctgctcggcagcttcgggtgcaagcccctgaccatgttcctgatcaccgagaacaagatctggggccggaagtcctggcccctcaacgaggggatcatggcgatcggcatcgtcagcatcctgctgtccagcctcctgaagaacgacgtgcccctggccgggccgctcatcgccggcggcatgctgatcgcctgctacgtgatcagcgggtccagcgccgacctgtccctcgagaaggcggccgaggtcagctgggagcaggaggccgagcactccggcacgagccacaacatcctggtggaggtgcaggacgacgggaccatgaagatcaaggacgaggagcgcgacgacaccctgaccatcctcctgaaggccacgctgctcgccgtctccggcgtgtaccccatgagcatccccgcgaccctgttcgtgtggtacttctggcagaagaagaagcagcggtccggggtcctgtgggacacccccagcccgcccgaggtggagcgcgccgtgctcgacgacggcatctaccggatcctgcagcgcggcctgctggggcggtcccaggtcggcgtgggggtgttccaggacggcgtcttccacaccatgtggcacgtgacgcgcggggccgtgctcatgtaccagggcaagcggctggagcccagctgggcctccgtcaagaaggacctgatcagctacggcgggggctggcgcttccaggggtcctggaacaccggcgaggaggtccaggtgatcgccgtcgagcccgggaagaacccgaagaacgtgcagaccacccccggcacgttcaagacccccgagggcgaggtgggggcgatcgccctcgacttcaagcccggcaccagcgggtccccgatcgtcaaccgggagggcaagatcgtgggcctgtacgggaacggcgtggtcaccacgagcgggacctacgtgtccgccatcgcccaggccaaggcgagccaggagggccccctgcccgagatcgaggacgaggtgttcaagaagcgcaacctcaccatcatggacctgcacccggggagcggcaagacccggcgctacctgcccgccatcgtccgggaggccatcaagcgcaagctccggacgctgatcctggcccccacccgcgtggtggcgtccgagatggccgaggccctcaagggcatgcccatccgctaccagaccaccgccgtcaagagcgagcacacggggcgggagatcgtggacctgatgtgccacgccaccttcaccatgcgcctgctctccccggtgcgggtccccaactacaacatgatcatcatggacgaggcgcacttcaccgaccccgccagcatcgccgcccgcggctacatctccacgcgggtggggatgggcgaggccgcggccatcttcatgaccgccacgccgcccgggagcgtggaggccttcccccagtccaacgccgtcatccaggacgaggagcgcgacatccccgagcggagctggaactccggctacgactggatcaccgacttccccggcaagacggtgtggttcgtgcccagcatcaagtccgggaacgacatcgcgaactgcctgcgcaagaacggcaagcgggtcatccagctgagccgcaagaccttcgacaccgagtaccagaagaccaagaacaacgactgggactacgtggtgacgaccgacatctccgagatgggggccaacttccgggccgaccgcgtcatcgacccccggcgctgcctcaagcccgtgatcctgaaggacggccccgagcgggtgatcctggccgggccgatgcccgtcaccgtggcgagcgccgcccagcgccggggccgcatcggccggaaccagaacaaggagggggaccagtacgtctacatgggccagcccctcaacaacgacgaggaccacgcccactggaccgaggccaagatgctgctggacaacatcaacacgcccgaggggatcatcccggccctcttcgagcccgagcgcgagaagaacgccgccatcgacggcgagtaccgcctgcgcggggaggcccgcaagaccttcgtggagctgatgcggcgcggcgacctccccgtgtggctgtcctacaaggtcgccagcgagggcttccagtactccgaccggcgctggtgcttcgacggggagcggaacaaccaggtgctggaggagaacatggacgtggagatctggaccaaggagggcgagcgcaagaagctccggccccgctggctggacgcgcggacctacagcgacccgctggccctccgcgagttcaaggagttcgccgccgggcggcgctccgtcagcggcgacctgatcctggagatcggcaagctcccccagcacctgaccctgcgggcccagaacgcgctcgacaacctggtgatgctgcacaacagcgagcagggcgggaaggcctaccgccacgccatggaggagctccccgacacgatcgagaccctgatgctgctcgccctgatcgcggtgctgaccgggggcgtcaccctcttcttcctgtccgggaagggcctgggcaagacgagcatcgggctcctgtgcgtgaccgcctccagcgccctgctctggatggcctccgtggagccccactggatcgccgcgagcatcatcctggagttcttcctgatggtcctcctgatcccggagcccgaccggcagcgcacgccccaggacaaccagctggcctacgtggtgatcggcctcctgttcatgatcctgaccgtcgccgccaacgagatggggctcctggagacgaccaagaaggacctgggcatcgggcacgtggccgcggagaaccaccagcacgccaccatgctcgacgtggacctgcggccggcctccgcctggaccctgtacgccgtcgcgacgaccgtgatcacccccatgatgcgccacaccatcgagaacacgaccgccaacatcagcctcaccgccatcgccaaccaggccgcgatcctgatgggcctggacaagggctggcccatctccaagatggacatcggggtgcccctcctggccctgggctgctacagccaggtcaacccgctcaccctgacggccgccgtgctgatgctcgtggcgcactacgccatcatcgggcccggcctgcaggccaaggccacccgggaggcccagaagcgcaccgcggccgggatcatgaagaaccccaccgtcgacggcatcgtggccatcgacctggaccccgtggtctacgacgccaagttcgagaagcagctcggccagatcatgctgctgatcctctgcacgtcccagatcctgctgatgcgcaccacctgggccctctgcgagagcatcaccctggcgacggggccgctgaccaccctctgggagggctcccccgggaagttctggaacaccacgatcgccgtgagcatggccaacatcttccggggctcctacctggccggcgccgggctggcgttcagcctcatgaagtccctgggcgggggccgccgggggaccggcgcccagggcgagaccctgggggagaagtggaagcgccagctcaaccagctgagcaagtccgagttcaacacctacaagcggagcggcatcatggaggtggaccgcagcgaggccaaggaggggctgaagcggggcgagacgaccaagcacgccgtctcccgcgggaccgcgaagctccggtggttcgtggagcgcaacctggtgaagcccgagggcaaggtcatcgacctgggctgcgggcggggcgggtggagctactactgcgccggcctgaagaaggtgaccgaggtgaaggggtacaccaagggcggccccgggcacgaggagccgatccccatggccacgtacggctggaacctcgtcaagctgcactccgggaaggacgtgttcttcatcccgcccgagaagtgcgacaccctgctctgcgacatcggcgagagctccccgaaccccaccatcgaggaggggcgcaccctgcgggtgctgaagatggtcgagccctggctccgcggcaaccagttctgcatcaagatcctgaacccctacatgccgagcgtggtggaggccctggagcagatgcagcggaagcacggcgggatgctcgtccgcaaccccctgtcccggaacagcacgcacgagatgtactgggtgtcctgcggcaccgggaacatcgtgagcgccgtcaacatgacctcccgcatgctgctcaaccggttcaccatggcgcaccgcaagcccacgtacgagcgcgacgtggacctgggcgccggcacccggcacgtggccgtcgagcccgaggtggccaacctggacatcatcgggcagcgcatcgagaacatcaagaacgagcacaagagcacctggcactacgacgaggacaacccgtacaagacctgggcctaccacggctcctacgaggtgaagcccagcgggtccgcgagctccatggtcaacggcgtggtccggctcctgacgaagccctgggacgtgatccccatggtgacccagatcgccatgaccgacaccacgccgttcgggcagcagcgcgtcttcaaggagaaggtggacacccggacgccccgggccaagcggggcaccacgcagatcatggaggtgaccgccaagtggctgtggggcttcctcagccgcaacaagaagccccggatctgcacccgcgaggagttcacccggaaggtccgctccaacgccgcgatcggggccgtgttcgtggacgagaaccagtggaacagcgccaaggaggccgtcgaggacgagcggttctgggacctggtgcaccgcgagcgggagctgcacaagcagggcaagtgcgcgacgtgcgtgtacaacatgatggggaagcgcgagaagaagctcggcgagttcgggaaggccaagggcagccgggccatctggtacatgtggctgggcgcccgcttcctggagttcgaggccctcgggttcatgaacgaggaccactggttctcccgggagaacagcctgtccggcgtcgagggggagggcctgcacaagctcgggtacatcctgcgcgacatcagcaagatcccgggcggcaacatgtacgcggacgacaccgccgggtgggacacccggatcaccgaggacgacctgcagaacgaggccaagatcacggagatcatggagcccgagcacgccctcctggccacctccatcttcaagctgacctaccagaacaaggtggtgcgcgtccagcgccccgcgaagaacggcaccgtgatggacgtgatcagccggcgcgaccagcgggggtccggccaggtcggcacgtacgggctcaacaccttcaccaacatggaggtgcagctgatccgccagatggagagcgagggcatcttcctgccctccgagctcgagaccccgaacctggccgagcgggtgctggactggctcgagaagcacggggccgagcgcctgaagcggatggccatcagcggcgacgactgcgtcgtgaagcccatcgacgaccgcttcgccacggcgctgaccgccctcaacgacatggggaaggtgcggaaggacatcccccagtgggagccctccaagggctggaacgactggcagcaggtcccgttctgcagccaccacttccaccagctgatcatgaaggacggccgcgagatcgtggtgccctgccggaaccaggacgagctggtcgggcgcgcccgggtgtcccagggcgccgggtggagcctccgcgagaccgcctgcctgggcaagtcctacgcgcagatgtggcagctgatgtacttccaccggcgcgacctccggctggccgccaacgccatctgcagcgcggtgcccgtcgactgggtgcccacctcccgcaccacgtggagcatccacgcccaccaccagtggatgaccaccgaggacatgctgagcgtgtggaaccgggtctggatcgaggagaacccgtggatggaggacaagacccacgtgtccagctgggaggaggtgccctacctcgggaagcgcgaggaccagtggtgcggctccctgatcggcctgacggcccgcgccacctgggccaccaacatccaggtcgcgatcaaccaggtgcggcgcctcatcgggaacgagaactacctggactacatgaccagcatgaagcggttcaagaacgagtccgaccccgagggcgccctgtggtga

SEQ ID NO: 8114 - RNA, 9879 nt, synthetic construct
  misc_feature 1..9879: note = derived and/or modified CDS sequence (opt1) from DENV-1__KJ189335__SS-prME
  source 1..9879: mol_type = other RNA
agcgtgaccatgctgctcatgctgctgcccaccgccctcgccttccacctgaccacccggggcggggagccgcacatgatcgtgagcaagcaggagcggggcaagagcctcctcttcaagacctccgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccttcttcctggcgcacgccatcggcaccagcatcacccagaaggggatcatcttcatcctcctgatgctggtgaccccctccatggccatgcgctgcgtcggcatcggcaaccgggacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcgatcctgcgcaagctctgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcgggctgttcggcaaggggagcctcctgacgtgcgccaagttcaagtgcgtgaccaagctggagggcaagatcgtgcagtacgagaacctcaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctgaccctcgactgcagcccccggaccggcctggacttcaacgagatggtgctgctcacgatgaaggagaagtcctggctggtccacaagcagtggttcctggacctcccgctgccctggacctccggggccagcaccagccaggagacctggaaccgccaggacctgctcgtgacgttcaagaccgcccacgcgaagaagcaggaggtggtcgtgctgggctcccaggagggcgccatgcacaccgccctgaccggggccacggagatccagaccagcggcaccaccacgatcttcgccgggcacctcaagtgccggctgaagatggacaagctgaccctcaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctgatcaccgccaacccgatcgtgaccgacaaggagaagcccgtcaacatcgagaccgagccgcccttcggggagagctacatcgtggtgggcgccggcgagaaggcgctcaagctgtcctggttcaagaaggggagctccatcggcaagatgttcgaggccacggcccgcggggcgcgccggatggccatcctgggcgacaccgcgtgggacttcgggagcatcggcggcgtcttcacctccgtggggaagctcgtgcaccaggtcttcggcaccgcctacggggtgctgttcagcggcgtgtcctggacgatgaagatcgggatcggcatcctgctcacctggctgggcctgaacagccgctccaccagcctctccatgacctgcatcgccgtcgggatggtgacgctgtacctgggcgtgatggtccaggccgacagcgggtgcgtgatcaactggaagggccgcgagctcaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcacggtggtcgtgggggacgccaacggcatcctcgcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctgcgcgactcctacacccagatgtgcgaccaccggctcatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctgtggtccaacggcgtgctcgagagcgagatgatcatccccaagatctacgggggcccgatctcccagcacaactaccggcccgggtacttcacccagacggccggcccctggcacctggggaagctggagctcgacttcgacctgtgcgagggcaccaccgtcgtggtggacgagcactgcggcaaccgcgggccgagcctgcggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctggtgcgcagcatggtctccgccggcagcggcgaggtggacagcttctccctcgggatcctgtgcgtgagcatcatgatcgaggaggtcatgcggtcccgctggagccggaagatgctgatgacgggcaccctcgccgtgttcctgctgctcgtgatggggcagctgacctggaacgacctgatccgcctctgcatcatggtcggcgccaacgcgtccgaccgcatggggatgggcaccacgtacctggccctgatggccaccttcaagatgcggccgatgttcgccgtgggcctcctgttccgccggctgaccagccgcgaggtgctcctgctgaccatcgggctctccctggtcgccagcgtggagctgcccaactccctcgaggagctgggcgacgggctggcgatgggcatcatgatgctcaagctgctgacggagttccagccccaccagctctggaccaccctgctgagcctcaccttcatcaagacgaccctgtccctggactacgcctggaagaccaccgccatggccctcagcatcgtctccctgttccccctgtgcctcagcacgacctcccagaagaccacctggctgccggtgctgctcggcagcttcgggtgcaagcccctgaccatgttcctgatcacggagaacaagatctggggccggaagtcctggcccctcaacgaggggatcatggcgatcggcatcgtgagcatcctgctgtccagcctcctgaagaacgacgtccccctggccgggccgctcatcgccggcggcatgctgatcgcctgctacgtgatcagcgggtccagcgccgacctgtccctcgagaaggcggccgaggtgagctgggagcaggaggccgagcactccggcaccagccacaacatcctggtcgaggtgcaggacgacgggaccatgaagatcaaggacgaggagcgcgacgacaccctgacgatcctcctgaaggccaccctgctcgccgtgtccggcgtctaccccatgagcatccccgcgaccctgttcgtgtggtacttctggcagaagaagaagcagcggtccggggtgctgtgggacacccccagcccgcccgaggtcgagcgcgccgtgctcgacgacggcatctaccggatcctgcagcgcggcctgctggggcggtcccaggtgggcgtcggggtgttccaggacggcgtgttccacacgatgtggcacgtcacccgcggggccgtgctcatgtaccagggcaagcggctggagcccagctgggcctccgtgaagaaggacctgatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggcgatcgccctcgacttcaagcccggcaccagcgggtccccgatcgtgaaccgggagggcaagatcgtcggcctgtacgggaacggcgtggtgacgaccagcgggacctacgtctccgccatcgcccaggccaaggcgagccaggagggccccctgcccgagatcgaggacgaggtgttcaagaagcgcaacctcaccatcatggacctgcacccggggagcggcaagacgcggcgctacctgcccgccatcgtgcgggaggccatcaagcgcaagctccggaccctgatcctggcccccacccgcgtcgtggcgtccgagatggccgaggccctcaagggcatgcccatccgctaccagaccacggccgtcaagagcgagcacaccgggcgggagatcgtcgacctgatgtgccacgccaccttcaccatgcgcctgctctccccggtgcgggtgcccaactacaacatgatcatcatggacgaggcgcacttcacggaccccgccagcatcgccgcccgcggctacatctccacccgggtcgggatgggcgaggccgcggccatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgcgaactgcctgcgcaagaacggcaagcgggtgatccagctgagccgcaagaccttcgacaccgagtaccagaagacgaagaacaacgactgggactacgtcgtgaccaccgacatctccgagatgggggccaacttccgggccgaccgcgtgatcgacccccggcgctgcctcaagcccgtcatcctgaaggacggccccgagcgggtgatcctggccgggccgatgcccgtgaccgtcgcgagcgccgcccagcgccggggccgcatcggccggaaccagaacaaggagggggaccagtacgtgtacatgggccagcccctcaacaacgacgaggaccacgcccactggacggaggccaagatgctgctggacaacatcaacacccccgaggggatcatcccggccctcttcgagcccgagcgcgagaagaacgccgccatcgacggcgagtaccgcctgcgcggggaggcccgcaagaccttcgtcgagctgatgcggcgcggcgacctccccgtgtggctgtcctacaaggtggccagcgagggcttccagtactccgaccggcgctggtgcttcgacggggagcggaacaaccaggtcctggaggagaacatggacgtggagatctggaccaaggagggcgagcgcaagaagctccggccccgctggctggacgcgcggacctacagcgacccgctggccctccgcgagttcaaggagttcgccgccgggcggcgctccgtgagcggcgacctgatcctggagatcggcaagctcccccagcacctgacgctgcgggcccagaacgcgctcgacaacctggtcatgctgcacaacagcgagcagggcgggaaggcctaccgccacgccatggaggagctccccgacaccatcgagaccctgatgctgctcgccctgatcgcggtgctgaccgggggcgtgaccctcttcttcctgtccgggaagggcctgggcaagaccagcatcgggctcctgtgcgtcaccgcctccagcgccctgctctggatggcctccgtggagccccactggatcgccgcgagcatcatcctggagttcttcctgatggtgctcctgatcccggagcccgaccggcagcgcacgccccaggacaaccagctggcctacgtcgtgatcggcctcctgttcatgatcctgacggtggccgccaacgagatggggctcctggagaccaccaagaaggacctgggcatcgggcacgtcgccgcggagaaccaccagcacgccaccatgctcgacgtggacctgcggccggcctccgcctggacgctgtacgccgtggcgaccaccgtcatcacccccatgatgcgccacacgatcgagaacaccaccgccaacatcagcctcaccgccatcgccaaccaggccgcgatcctgatgggcctggacaagggctggcccatctccaagatggacatcggggtgcccctcctggccctgggctgctacagccaggtgaacccgctcacgctgaccgccgccgtcctgatgctcgtggcgcactacgccatcatcgggcccggcctgcaggccaaggccacccgggaggcccagaagcgcaccgcggccgggatcatgaagaaccccacggtggacggcatcgtcgccatcgacctggaccccgtggtgtacgacgccaagttcgagaagcagctcggccagatcatgctgctgatcctctgcacctcccagatcctgctgatgcgcaccacctgggccctctgcgagagcatcacgctggcgaccgggccgctgaccaccctctgggagggctcccccgggaagttctggaacacgaccatcgccgtcagcatggccaacatcttccggggctcctacctggccggcgccgggctggcgttcagcctcatgaagtccctgggcgggggccgccgggggaccggcgcccagggcgagaccctgggggagaagtggaagcgccagctcaaccagctgagcaagtccgagttcaacacgtacaagcggagcggcatcatggaggtggaccgcagcgaggccaaggaggggctgaagcggggcgagaccaccaagcacgccgtgtcccgcgggaccgcgaagctccggtggttcgtcgagcgcaacctggtgaagcccgagggcaaggtgatcgacctgggctgcgggcggggcgggtggagctactactgcgccggcctgaagaaggtcaccgaggtgaaggggtacacgaagggcggccccgggcacgaggagccgatccccatggccacctacggctggaacctcgtgaagctgcactccgggaaggacgtcttcttcatcccgcccgagaagtgcgacaccctgctctgcgacatcggcgagagctccccgaaccccaccatcgaggaggggcgcacgctgcgggtgctgaagatggtggagccctggctccgcggcaaccagttctgcatcaagatcctgaacccctacatgccgagcgtcgtggaggccctggagcagatgcagcggaagcacggcgggatgctcgtgcgcaaccccctgtcccggaacagcacccacgagatgtactgggtctcctgcggcaccgggaacatcgtgagcgccgtgaacatgacctcccgcatgctgctcaaccggttcacgatggcgcaccgcaagcccacctacgagcgcgacgtcgacctgggcgccggcacccggcacgtggccgtggagcccgaggtcgccaacctggacatcatcgggcagcgcatcgagaacatcaagaacgagcacaagagcacctggcactacgacgaggacaacccgtacaagacgtgggcctaccacggctcctacgaggtgaagcccagcgggtccgcgagctccatggtgaacggcgtcgtgcggctcctgaccaagccctgggacgtcatccccatggtgacccagatcgccatgaccgacacgaccccgttcgggcagcagcgcgtgttcaaggagaaggtcgacacccggacgccccgggccaagcggggcacgacccagatcatggaggtgaccgccaagtggctgtggggcttcctcagccgcaacaagaagccccggatctgcacccgcgaggagttcacgcggaaggtgcgctccaacgccgcgatcggggccgtcttcgtggacgagaaccagtggaacagcgccaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggccctcgggttcatgaacgaggaccactggttctcccgggagaacagcctgtccggcgtggagggggagggcctgcacaagctcgggtacatcctgcgcgacatcagcaagatcccgggcggcaacatgtacgcggacgacaccgccgggtgggacacccggatcacggaggacgacctgcagaacgaggccaagatcaccgagatcatggagcccgagcacgccctcctggccacctccatcttcaagctgacctaccagaacaaggtcgtgcgcgtgcagcgccccgcgaagaacggcacggtcatggacgtgatcagccggcgcgaccagcgggggtccggccaggtgggcacctacgggctcaacaccttcaccaacatggaggtccagctgatccgccagatggagagcgagggcatcttcctgccctccgagctcgagacgccgaacctggccgagcgggtgctggactggctcgagaagcacggggccgagcgcctgaagcggatggccatcagcggcgacgactgcgtggtcaagcccatcgacgaccgcttcgccaccgcgctgaccgccctcaacgacatggggaaggtgcggaaggacatcccccagtgggagccctccaagggctggaacgactggcagcaggtcccgttctgcagccaccacttccaccagctgatcatgaaggacggccgcgagatcgtcgtgccctgccggaaccaggacgagctggtggggcgcgcccgggtctcccagggcgccgggtggagcctccgcgagaccgcctgcctgggcaagtcctacgcgcagatgtggcagctgatgtacttccaccggcgcgacctccggctggccgccaacgccatctgcagcgcggtgcccgtggactgggtccccacctcccgcacgacctggagcatccacgcccaccaccagtggatgaccaccgaggacatgctgagcgtgtggaaccgggtgtggatcgaggagaacccgtggatggaggacaagacgcacgtctccagctgggaggaggtgccctacctcgggaagcgcgaggaccagtggtgcggctccctgatcggcctgaccgcccgcgccacctgggccaccaacatccaggtggcgatcaaccaggtccggcgcctcatcgggaacgagaactacctggactacatgacgagcatgaagcggttcaagaacgagtccgaccccgagggcgccctgtggtga

SEQ ID NO: 8115 - RNA, 9879 nt, synthetic construct
  misc_feature 1..9879: note = derived and/or modified CDS sequence (opt1) from DENV-1__KJ189336__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatcgtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgtgagcatcatgatcgaggaggtcatgcggtcccgctggagccggaagatgctcatgacgggcaccctggccgtgttcctgctcctggtgatggggcagctgacctggaacgacctcatccgcctgtgcatcatggtcggcgccaacgcgtccgaccgcatggggatgggcaccacgtacctggccctcatggccaccttcaagatgcggccgatgttcgccgtggggctgctgttccgccggctcaccagccgcgaggtgctgctgctcaccatcgggctgtccctggtcgccagcgtggagctccccaactccctggaggagctgggcgacgggctcgcgatgggcatcatgatgctgaagctgctcacggagttccagccccaccagctgtggaccaccctgctcagcctgaccttcatcaagacgaccctgtccctcgactacgcctggaagaccaccgccatggccctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggccgtgtccggcgtctaccccatgagcatccccgcgaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcaccagcgggtccccgatcgtgaaccgggagggcaagatcgtcggcctgtacgggaacggcgtggtgacgaccagcgggacctacgtctccgccatcgcccaggccaaggcgagccaggagggccccctccccgagatcgaggacgaggtgttcaagaagcgcaacctgaccatcatggacctgcacccggggagcggcaagacgcggcgctacctccccgccatcgtgcgggaggccatcaagcgcaagctgcggaccctgatcctcgcccccacccgcgtcgtggcgtccgagatggccgaggccctgaagggcatgcccatccgctaccagaccacggccgtcaagagcgagcacaccgggcgggagatcgtcgacctgatgtgccacgccaccttcaccatgcgcctcctgtccccggtgcgggtgcccaactacaacatgatcatcatggacgaggcgcacttcacggaccccgccagcatcgccgcccgcggctacatctccacccgggtcgggatgggcgaggccgcggccatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgcgaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgccgggccgatgcccgtgaccgtcgcgagcgccgcccagcgccggggccgcatcggccggaaccagaacaaggagggggaccagtacgtgtacatgggccagcccctgaacaacgacgaggaccacgcccactggacggaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtggcctccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcgcggacctactccgacccgctcgccctgcgcgagttcaaggagttcgccgccgggcggcgcagcgtgagcggcgacctgatcctcgagatcggcaagctgccccagcacctgacgctccgggcccagaacgcgctggacaacctggtcatgctccacaactccgagcagggcgggaaggcctaccgccacgccatggaggagctgcccgacaccatcgagaccctgatgctcctggccctgatcgcggtgctcaccgggggcgtgacgctgttcttcctgagcgggaagggcctcggcaagacctccatcgggctgctgtgcgtcaccgccagctccgccctcctgtggatggccagcgtggagccccactggatcgccgcgtccatcatcctggagttcttcctcatggtgctgctgatcccggagcccgaccggcagcgcacgccccaggacaaccagctcgcctacgtcgtgatcggcctgctgttcatgatcctcacggtggccgccaacgagatggggctgctggagaccaccaagaaggacctcggcatcgggcacgtcgccgcggagaaccaccagcacgccaccatgctggacgtggacctgcggccggccagcgcctggacgctctacgccgtggcgaccaccgtcatcacccccatgatgcgccacacgatcgagaacaccaccgccaacatctccctgaccgccatcgccaaccaggccgcgatcctgatgggcctcgacaagggctggcccatcagcaagatggacatcggggtgcccctgctggccctcggctgctactcccaggtgaacccgctgacgctgaccgccgccgtcctcatgctggtggcgcactacgccatcatcgggcccggcctgcaggccaaggccacccgggaggcccagaagcgcaccgcggccgggatcatgaagaaccccacggtggacggcatcgtcgccatcgacctcgaccccgtggtgtacgacgccaagttcgagaagcagctgggccagatcatgctgctcatcctgtgcaccagccagatcctgctcatgcgcaccacctgggccctgtgcgagtccatcacgctggcgaccgggccgctcaccaccctgtgggagggcagccccgggaagttctggaacacgaccatcgccgtctccatggccaacatcttccggggcagctacctggccggcgccgggctcgcgttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgccgtgagccgcgggaccgcgaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacacgaagggcggccccgggcacgaggagccgatccccatggccacctacggctggaacctggtgaagctgcacagcgggaaggacgtcttcttcatgccgcccgagaagtgcgacaccctcctgtgcgacatcggcgagtccagcccgaaccccaccatcgaggaggggcgcacgctgcgggtgctcaagatggtggagccctggctgcgcggcaaccagttctgcatcaagatcctgaacccctacatgccgtccgtcgtggaggccctcgagcagatgcagcggaagcacggcgggatgctggtgcgcaaccccctgagccggaactccacccacgagatgtactgggtcagctgcggcaccgggaacatcgtgtccgccgtgaacatgaccagccgcatgctcctgaaccggttcacgatggcgcaccgcaagcccacctacgagcgcgacgtcgacctgggcgccggcacccggcacgtggccgtggagcccgaggtcgccaacctcgacatcatcgggcagcgcatcgagaacatcaagaacgagcacaagtccacctggcactacgacgaggacaacccgtacaagacgtgggcctaccacggcagctacgaggtgaagccctccgggagcgcgtccagcatggtgaacggcgtcgtgcggctgctgaccaagccctgggacgtcatccccatggtgacccagatcgccatgaccgacacgaccccgttcgggcagcagcgcgtgttcaaggagaaggtcgacacccggacgccccgggccaagcggggcacgacccagatcatggaggtgaccgccaagtggctctggggcttcctgtcccgcaacaagaagccccggatctgcacccgcgaggagttcacgcggaaggtgcgcagcaacgccgcgatcggggccgtcttcgtggacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacaccgccgggtgggacacccggatcacggaggacgacctccagaacgaggccaagatcaccgagatcatggagcccgagcacgccctgctggccaccagcatcttcaagctcacctaccagaacaaggtcgtgcgcgtgcagcgccccgcgaagaacggcacggtcatggacgtgatctcccggcgcgaccagcgggggagcggccaggtgggcacctacgggctgaacaccttcaccaacatggaggtccagctgatccgccagatggagtccgagggcatcttcctccccagcgagctggagacgccgaacctggccgagcgggtgctcgactggctggagaagcacggggccgagcgcctgaagcggatggccatctccggcgacgactgcgtggtcaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctcgtggggcgcgcccgggtcagccagggcgccgggtggtccctgcgcgagaccgcctgcctgggcaagagctacgcgcagatgtggcagctcatgtacttccaccggcgcgacctgcggctggccgccaacgccatctgctccgcggtgcccgtggactgggtccccaccagccgcacgacctggagcatccacgcccaccaccagtggatgaccaccgaggacatgctctccgtgtggaaccgggtgtggatcgaggagaacccgtggatggaggacaagacgcacgtcagctcctgggaggaggtgccctacctggggaagcgcgaggaccagtggtgcggcagcctgatcggcctcaccgcccgcgccacctgggccaccaacatccaggtggcgatcaaccaggtccggcgcctgatcgggaacgagaactacctggactacatgacgtccatgaagcggttcaagaacgagagcgaccccgagggcgccctctggtga

SEQ ID NO: 8116 - RNA, 9879 nt, synthetic construct
  misc_feature 1..9879: note = derived and/or modified CDS sequence (opt1) from DENV-1__KJ189337__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagatctggaaccgccaggacctcctggtgaccttcaagacggcccacgcgaagaagcaggaggtggtcgtgctgggctcccaggagggcgccatgcacaccgccctcaccggggccaccgagatccagacgagcggcaccaccaccatcttcgccgggcacctgaagtgccggctgaagatggacaagctcacgctgaagggcacctcctacgtgatgtgcaccgggagcttcaagctggagaaggaggtcgcggagacccagcacggcacggtgctggtgcaggtcaagtacgagggcaccgacgccccctgcaagatccccttctccacccaggacgagaagggggtgacccagaacggccgcctcatcacggccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtcttcacctccgtggggaagctggtgcaccaggtcttcggcaccgcctacggggtgctgttcagcggcgtgtcctggaccatgaagatcgggatcggcatcctcctgacgtggctgggcctcaacagccgctccaccagcctgtccatgacctgcatcgccgtcgggatggtgaccctgtacctcggcgtgatggtccaggccgacagcgggtgcgtgatcaactggaagggccgcgagctgaagtgcgggtccggcatcttcgtgacgaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcaccgtggtcgtgggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacaaccagcgggcctggaacatctgggaggtggaggactacggcttcgggatcttcaccacgaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacctgcacgtggcccaagagccacaccctctggtccaacggcgtgctggagagcgagatgatcatccccaagatctacgggggcccgatctcccagcacaactaccggcccgggtacttcacccagaccgccggcccctggcacctggggaagctcgagctggacttcgacctgtgcgagggcacgaccgtcgtggtggacgagcactgcggcaaccgcgggccgagcctccggaccaccacggtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgaccggcacgctggccgtcttcctgctcctgatcatggggcagctgacctggaacgacctcatccgcctgtgcatcatggtgggcgcgaacgcctccgaccgcatggggatgggcaccacctacctggccctcatggccacgttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcaccgagttccagccccaccagctgtggacgaccctgctcagcctgaccttcatcaagaccacgctgtccctcgactacgcctggaagaccaccgccatggcgctgagcatcgtctccctgttccccctctgcctgagcaccacgtcccagaagaccacctggctgccggtgctcctgggcagcttcgggtgcaagcccctgaccatgttcctcatcaccgagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcacgagccacaacatcctggtggaggtgcaggacgacgggaccatgaagatcaaggacgaggagcgcgacgacaccctcaccatcctgctgaaggccacgctcctggcggtctccggcgtgtaccccatgagcatccccgccaccctgttcgtgtggtacttctggcagaagcggaagcagcgctccggggtcctctgggacacccccagcccgcccgaggtggagcgggccgtgctggacgacggcatctaccgcatcctgcagcggggcctgctcgggcgctcccaggtcggcgtgggggtgttccaggacggcgtcttccacaccatgtggcacgtgacgcgcggggccgtgctgatgtaccagggcaagcgcctggagcccagctgggcctccgtcaagaaggacctcatcagctacggcgggggctggcggttccaggggtcctggaacaccggcgaggaggtccaggtgatcgcggtcgagcccgggaagaacccgaagaacgtgcagaccacccccggcacgttcaagacccccgagggcgaggtgggggccatcgccctggacttcaagcccggcaccagcgggtccccgatcgtcaaccgcgagggcaagatcgtgggcctgtacgggaacggcgtggtcaccacgagcgggacctacgtgtccgccatcgcccaggcgaaggccagccaggagggccccctccccgagatcgaggacgaggtgttcaagaagcggaacctgaccatcatggacctgcacccggggagcggcaagacccgccggtacctccccgccatcgtccgcgaggccatcaagcggaagctgcgcacgctgatcctcgcgcccacccgcgtggtggcctccgagatggccgaggccctgaagggcatgcccatccggtaccagaccaccgccgtcaagagcgagcacacggggcgcgagatcgtggacctgatgtgccacgcgaccttcaccatgcggctcctgtccccggtgcgcgtccccaactacaacatgatcatcatggacgaggcccacttcaccgaccccgccagcatcgccgcccggggctacatctccacgcgcgtggggatgggcgaggcggccgccatcttcatgaccgccacgccgcccgggagcgtggaggccttcccccagtccaacgcggtcatccaggacgaggagcgggacatccccgagcgcagctggaactccggctacgactggatcaccgacttccccggcaagacggtgtggttcgtgcccagcatcaagtccgggaacgacatcgccaactgcctgcggaagaacggcaagcgcgtcatccagctcagccggaagaccttcgacaccgagtaccagaagaccaagaacaacgactgggactacgtggtgacgaccgacatctccgagatgggggccaacttccgcgccgaccgggtcatcgacccccgccggtgcctgaagcccgtgatcctgaaggacggccccgagcgcgtgatcctcgcggggccgatgcccgtcaccgtggccagcgccgcccagcggcgcggccggatcggccgcaaccagaacaaggagggggaccagtacgtgtacatgggccagcccctgaacaacgacgaggaccacgcccactggaccgaggcgaagatgctgctcgacaacatcaacacgcccgaggggatcatcccggccctgttcgagcccgagcgcgagaagtccgccgccatcgacggcgagtaccggctgcgcggggaggcccggaagaccttcgtcgagctcatgcgccggggcgacctgcccgtgtggctgagctacaaggtcgcgtccgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctactccgacccgctcgccctgcgggagttcaaggagttcgccgccgggcgccggagcgtcagcggcgacctgatcctcgagatcggcaagctgccccagcacctgaccctccgcgcgcagaacgccctggacaacctggtgatgctccacaactccgagcagggcgggaaggcctaccggcacgccatggaggagctgcccgacacgatcgagaccctgatgctcctggcgctgatcgccgtgctcaccgggggcgtcaccctgttcttcctgagcgggaagggcctcggcaagacgtccatcgggctgctgtgcgtgaccgccagctccgccctcctgtggatggccagcgtggagccccactggatcgcggcctccatcatcctggagttcttcctcatggtcctgctgatcccggagcccgaccgccagcggacgccccaggacaaccagctcgcctacgtggtgatcggcctgctgttcatgatcctcaccgtcgccgccaacgagatggggctgctggagacgaccaagaaggacctcggcatcgggcacgtggcggccgagaaccaccagcacgccaccatgctggacgtggacctgcgcccggccagcgcctggaccctctacgcggtcgccacgaccgtgatcacccccatgatgcggcacaccatcgagaacacgaccgccaacatctccctgaccgccatcgccaaccaggcggccatcctgatgggcctcgacaagggctggcccatcagcaagatggacatcggggtgcccctgctggccctcggctgctactcccaggtcaacccgctgaccctgacggccgcggtgctcatgctggtggcccactacgccatcatcgggcccggcctgcaggccaaggccacccgcgaggcgcagaagcgcaccgccgccgggatcatgaagaaccccaccgtcgacggcatcgtggccatcgacctcgaccccgtggtctacgacgccaagttcgagaagcagctgggccagatcatgctgctcatcctgtgcacgagccagatcctgctcatgcggaccacctgggcgctgtgcgagtccatcaccctggccacggggccgctcaccaccctgtgggagggcagccccgggaagttctggaacaccacgatcgccgtgtccatggccaacatcttccgcggcagctacctggccggcgcggggctcgccttctccctgatgaagtccctgggcgggggccggcgcgggaccggcgcccagggcgagaccctcggggagaagtggaagcggcagctgaaccagctgtccaagagcgagttcaacacctacaagcgcagcggcatcatggaggtggaccggtccgaggccaaggaggggctcaagcgcggcgagacgaccaagcacgcggtcagccgggggaccgccaagctgcgctggttcgtggagcggaacctggtgaagcccgagggcaaggtcatcgacctgggctgcgggcgcggcgggtggtcctactactgcgccggcctcaagaaggtgaccgaggtgaaggggtacaccaagggcggccccgggcacgaggagccgatccccatggccacgtacggctggaacctggtcaagctgcacagcgggaaggacgtgttcttcatgccgcccgagaagtgcgacaccctcctgtgcgacatcggcgagtccagcccgaaccccaccatcgaggaggggcggaccctgcgcgtgctcaagatggtcgagccctggctgcggggcaaccagttctgcatcaagatcctgaacccctacatgccgtccgtggtggagacgctcgagcagatgcagcgcaagcacggcgggatgctggtccggaaccccctgagccgcaactccacccacgagatgtactgggtgagctgcggcaccgggaacatcgtgtccgccgtcaacatgaccagccggatgctcctgaaccgcttcacgatggcgcaccgcaagcccaccttcgagcgggacgtggacctgggcgccggcacccgccacgtggccgtcgagcccgaggtggccaacctcgacatcatcgggcagcggatcgagaacgtgaagaacgagcacaagtccacctggcactacgacgaggacaacccgtacaagacgtgggcctaccacggcagctacgaggtcaagccctccgggagcgcgtccagcatggtgaacggcgtggtccgcctgctgaccaagccctgggacgtgatccccatggtcacccagatcgccatgaccgacacgaccccgttcgggcagcagcgggtgttcaaggagaaggtggacacccgcacgccccgggccaagcgcggcacgacccagatcatggaggtcaccgccaagtggctctggggcttcctgtcccggaacaagaagccccgcatctgcacccgggaggagttcacgcgcaaggtgcggagcaacgccgcgatcggggccgtgttcgtcgacgagaaccagtggaacagcgccaaggaggccgtggaggacgagcgcttctgggacctggtgcaccgggagcgcgagctccacaagcagggcaagtgcgcgacctgcgtctacaacatgatggggaagcgggagaagaagctgggcgagttcgggaaggccaagggctcccgcgccatctggtacatgtggctgggcgcccggttcctcgagttcgaggccctggggttcatgaacgaggaccactggttcagccgcgagaactccctgagcggcgtggagggggagggcctccacaagctggggtacatcctgcgggacatctccaagatcccgggcggcaacatgtacgcggacgacaccgccgggtgggacacccgcatcacggaggacgacctccagaacgaggccaagatcaccgacatcatggagcccgagcacgccctgctggccaccagcatcttcaagctcacctaccagaacaaggtggtccgcgtgcagcggcccgcgaagaacggcacggtgatggacgtcatctcccgccgggaccagcgcgggagcggccaggtgggcacctacgggctgaacaccttcaccaacatggaggtgcagctgatccggcagatggagtccgagggcatcttcctccccagcgagctggagacgccgaacctggccgagcgcgtcctcgactggctggagaagcacggggccgagcggctgaagcgcatggccatctccggcgacgactgcgtggtgaagcccatcgacgaccggttcgccaccgcgctcaccgccctgaacgacatggggaaggtccgcaaggacatcccccagtgggagcccagcaagggctggaacgactggcagcaggtcccgttctgctcccaccacttccaccagctgatcatgaaggacggccgggagatcgtggtcccctgccgcaaccaggacgagctcgtggggcgggcccgcgtgagccagggcgccgggtggtccctgcgggagaccgcctgcctgggcaagagctacgcgcagatgtggcagctcatgtacttccaccgccgggacctgcgcctggccgccaacgccatctgctccgcggtccccgtggactgggtgcccaccagccggacgacctggagcatccacgcccaccaccagtggatgaccaccgaggacatgctctccgtctggaaccgcgtgtggatcgaggagaacccgtggatggaggacaagacgcacgtgagctcctgggaggaggtcccctacctggggaagcgcgaggaccagtggtgcggcagcctgatcggcctcaccgcccgggccacctgggccaccaacatccaggtggcgatcaaccaggtgcgccggctgatcgggaacgagaactacctggactacatgacgtccatgaagcgcttcaagaacgagagcgaccccgagggcgccctctggtga

SEQ ID NO: 8117 - RNA, 9879 nt, synthetic construct
  misc_feature 1..9879: note = derived and/or modified CDS sequence (opt1) from DENV-1__KJ189340__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgtgagcatcatgatcgaggaggtcatgcggtcccgctggagccggaagatgctcatgacgggcaccctggccgtgttcctgctcctggtgatggggcagctgacctggaacgacctcatccgcctgtgcatcatggtcggcgccaacgcgtccgaccgcatggggatgggcaccacgtacctggccctcatggccaccttcaagatgcggccgatgttcgccgtgggcctgctgttccgccggctcaccagccgcgaggtgctgctgctcaccatcgggctgtccctggtcgccagcgtggagctccccaactccctggaggagctgggcgacgggctcgcgatgggcatcatgatgctgaagctgctcacggagttccagccccaccagctgtggaccaccctgctcagcctgaccttcatcaagacgaccctgtccctcgactacgcctggaagaccaccgccatggccctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggccgtgtccggcgtctaccccatgagcatccccgcgaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcaccagcgggtccccgatcgtgaaccgggagggcaagatcgtcggcctgtacgggaacggcgtggtgacgaccgggggcacctacgtcagcgccatcgcccaggccaaggcgtcccaggaggggcccctccccgagatcgaggacgaggtgttcaagaagcgcaacctgaccatcatggacctgcacccgggcagcggcaagacgcggcgctacctccccgccatcgtgcgggaggccatcaagcgcaagctgcggaccctgatcctcgcccccacccgcgtcgtggcgagcgagatggccgaggccctgaaggggatgcccatccgctaccagaccacggccgtgaagtccgagcacaccggccgggagatcgtcgacctgatgtgccacgccaccttcaccatgcgcctcctgagcccggtgcgggtgcccaactacaacatgatcatcatggacgaggcgcacttcacggaccccgcctccatcgccgcccgcgggtacatcagcacccgggtcggcatgggggaggccgcggccatcttcatgaccgccacgccgcccggctccgtggaggccttcccccagagcaacgccgtgatccaggacgaggagcgcgacatccccgagcggtcctggaacagcggctacgactggatcacggacttccccgggaagaccgtctggttcgtgccctccatcaagagcggcaacgacatcgcgaactgcctgcgcaagaacgggaagcgggtgatccagctctcccgcaagaccttcgacaccgagtaccagaagacgaagaacaacgactgggactacgtcgtgaccaccgacatcagcgagatgggcgccaacttccgggccgaccgcgtgatcgacccccggcgctgcctgaagcccgtcatcctgaaggacgggcccgagcgggtgatcctcgccggcccgatgcccgtgaccgtcgcgtccgccgcccagcgccggggccgcatcgggcggaaccagaacaaggagggcgaccagtacgtgtacatggggcagcccctgaacaacgacgaggaccacgcccactggacggaggccaagatgctgctcgacaacatcaacacccccgagggcatcatcccggcgctgttcgagcccgagcgcgagaagtccgccgccatcgacggggagtaccgcctgcggggcgaggcccgcaagaccttcgtcgagctcatgcggcgcggcgacctgcccgtgtggctgtcctacaaggtggccagcgaggggttccagtactccgaccggcgctggtgcttcgacggcgagcggaacaaccaggtcctcgaggagaacatggacgtggagatctggaccaaggagggggagcgcaagaagctgcggccccgctggctggacgcgcggacctacagcgacccgctcgccctgcgcgagttcaaggagttcgccgccggccggcgctccgtgagcggcgacctgatcctcgagatcgggaagctgccccagcacctgacgctccgggcccagaacgcgctggacaacctggtcatgctccacaacagcgagcagggcgggaaggcctaccgccacgccatggaggagctgcccgacaccatcgagaccctgatgctcctggccctgatcgcggtgctcaccggcggggtgacgctgttcttcctgtccggcaagggcctcgggaagaccagcatcggcctgctgtgcgtcaccgcctccagcgccctcctgtggatggcctccgtggagccccactggatcgccgcgagcatcatcctggagttcttcctcatggtgctgctgatcccggagcccgaccggcagcgcacgccccaggacaaccagctcgcctacgtcgtgatcgggctgctgttcatgatcctcacggtggccgccaacgagatgggcctgctggagaccaccaagaaggacctcgggatcggccacgtcgccgcggagaaccaccagcacgccaccatgctggacgtggacctgcggccggcctccgcctggacgctctacgccgtggcgaccaccgtcatcacccccatgatgcgccacacgatcgagaacaccaccgccaacatcagcctgaccgccatcgccaaccaggccgcgatcctgatgggcctcgacaaggggtggcccatctccaagatggacatcggcgtgcccctgctggccctcgggtgctacagccaggtgaacccgctgacgctgaccgccgccgtcctcatgctggtggcgcactacgccatcatcggccccgggctgcaggccaaggccacccgggaggcccagaagcgcaccgcggccggcatcatgaagaaccccacggtggacggcatcgtcgccatcgacctcgaccccgtggtgtacgacgccaagttcgagaagcagctggggcagatcatgctgctcatcctgtgcacctcccagatcctgctcatgcgcaccacctgggccctgtgcgagagcatcacgctggcgaccggcccgctcaccaccctgtgggaggggtcccccggcaagttctggaacacgaccatcgccgtcagcatggccaacatcttccggggctcctacctggccggggccggcctcgcgttcagcctgatgaagtccctcgggggcgggcgccgggggaccggcgcccagggggagaccctcggcgagaagtggaagcgccagctgaaccagctgagcaagtccgagttcaacacgtacaagcggagcgggatcatggaggtggaccgcagcgaggccaaggagggcctcaagcgcggggagaccaccaagcacgccgtgtcccgcggcaccgcgaagctgcggtggttcgtcgagcgcaacctggtgaagcccgagggcaaggtgatcgacctggggtgcggccgcgggggctggagctactactgcgccgggctcaagaaggtcaccgaggtgaagggctacacgaagggcgggcccggccacgaggagccgatccccatggccacctacgggtggaacctggtgaagctgcactccggcaaggacgtcttcttcatgccgcccgagaagtgcgacaccctcctgtgcgacatcggggagagctccccgaaccccaccatcgaggagggccgcacgctgcgggtgctcaagatggtggagccctggctgcgcggcaaccagttctgcatcaagatcctgaacccctacatgccgagcgtcgtggaggccctcgagcagatgcagcggaagcacgggggcatgctggtgcgcaaccccctgtcccggaacagcacccacgagatgtactgggtctcctgcgggaccggcaacatcgtgagcgccgtgaacatgacctcccgcatgctcctgaaccggttcacgatggcgcaccgcaagcccacctacgagcgcgacgtcgacctgggcgccgggacccggcacgtggccgtggagcccgaggtcgccaacctcgacatcatcggccagcgcatcgagaacatcaagaacgagcacaagagcacctggcactacgacgaggacaacccgtacaagacgtgggcctaccacgggtcctacgaggtgaagcccagcggctccgcgagctccatggtgaacggggtcgtgcggctgctgaccaagccctgggacgtcatccccatggtgacccagatcgccatgaccgacacgaccccgttcggccagcagcgcgtgttcaaggagaaggtcgacacccggacccccaaggccaagcgcggcacgacccagatcatggaggtgaccgccaagtggctctgggggttcctgagccggaacaagaagccccgcatctgcacccgggaggagttcacgcgcaaggtgcggtccaacgccgcgatcggcgccgtcttcgtggacgagaaccagtggaacagcgccaaggaggccgtggaggacgagcgcttctgggacctggtccaccgggagcgcgagctccacaagcaggggaagtgcgcgacctgcgtgtacaacatgatgggcaagcgggagaagaagctgggggagttcggcaaggccaagggcagccgcgccatctggtacatgtggctgggggcccggttcctcgagttcgaggccctgggcttcatgaacgaggaccactggttctcccgcgagaacagcctgtccggggtggagggcgaggggctccacaagctgggctacatcctgcgggacatcagcaagatcccgggcgggaacatgtacgcggacgacaccgccggctgggacacccgcatcacggaggacgacctccagaacgaggccaagatcaccgagatcatggagcccgagcacgccctgctggccacctccatcttcaagctcacctaccagaacaaggtcgtgcgggtgcagcgccccgcgaagaacgggacggtcatggacgtgatcagccgccgggaccagcgcggctccggccaggtggggacctacggcctgaacaccttcaccaacatggaggtccagctgatccggcagatggagagcgaggggatcttcctcccctccgagctggagacgccgaacctggccgagcgcgtgctcgactggctggagaagcacggcgccgagcggctgaagcgcatggccatcagcggggacgactgcgtggtcaagcccatcgacgaccggttcgccaccgcgctcaccgccctgaacgacatgggcaaggtgcgcaaggacatcccccagtgggagccctccaagggctggaacgactggcagcaggtcccgttctgcagccaccacttccaccagctgatcatgaaggacgggcgggagatcgtcgtgccctgccgcaaccaggacgagctcgtgggccgggcccgcgtctcccagggggccggctggagcctgcgggagaccgcctgcctggggaagtcctacgcgcagatgtggcagctcatgtacttccaccgccgggacctgcgcctggccgccaacgccatctgcagcgcggtgcccgtggactgggtccccacctcccggacgacctggagcatccacgcccaccaccagtggatgaccaccgaggacatgctcagcgtgtggaaccgcgtgtggatcgaggagaacccgtggatggaggacaagacgcacgtctccagctgggaggaggtgccctacctgggcaagcgggaggaccagtggtgcggctccctgatcgggctcaccgcccgcgccacctgggccaccaacatccaggtggcgatcaaccaggtccgccggctgatcggcaacgagaactacctggactacatgacgagcatgaagcgcttcaagaacgagtccgaccccgagggggccctctggtga

SEQ ID NO: 8118 - RNA, 9879 nt, synthetic construct
  misc_feature 1..9879: note = derived and/or modified CDS sequence (opt1) from DENV-1__KJ189341__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctgctgttcaagaccagcgcgggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtgacctacgggacctgcagccagaccggcggccaccgccgggagaagcgctccgtggccctggcgccccacgtggggctgggcctcgagacgcggaccgagacctggatgagctccgagggggcctggaagcagatccagcgggtcgagacctgggccctgcggcaccccggcttcacggtgatcgccctgttcctcgcgcacgccatcgggaccagcatcacccagaagggcatcatcttcatcctgctgatgctcgtgaccccctccatggccatgcgctgcgtcggcatcgggaaccgggacttcgtggagggcctgagcggggccacgtgggtggacgtcgtgctggagcacggctcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgccccacccagggcgaggccaccctggtggaggagcaggacgccaacttcgtctgccgccggaccttcgtggaccgcgggtggggcaacgggtgcggcctcttcgggaagggcagcctgctgacgtgcgccaagttcaagtgcgtgaccaagctcgagggcaagatcgtccagtacgagaacctgaagtactccgtgatcgtgaccgtccacaccggggaccagcaccaggtgggcaacgagacgaccgagcacgggaccatcgcgaccatcacgccccaggcccccacgagcgagatccagctgaccgactacggcgccctcaccctggactgcagcccccggaccgggctggacttcaacgagatggtcctcctgacgatgaaggagaagtcctggctggtgcacaagcagtggttcctcgacctgccgctgccctggacctccggcgccagcaccagccaggagacctggaaccgccaggacctcctggtgacgttcaagaccgcccacgcgaagaagcaggaggtcgtggtgctgggctcccaggagggggccatgcacaccgccctcaccggcgccacggagatccagaccagcgggaccaccacgatcttcgccggccacctgaagtgccggctgaagatggacaagctcaccctgaaggggacctcctacgtcatgtgcaccggccccttcaagctggagaaggaggtggcggagacgcagcacggcaccgtgctggtccaggtgaagtacgaggggaccgacgccccctgcaagatcccgttcagcacccaggacgagaagggcgtgacgcagaacgggcgcctcatcaccgccaaccccatcgtcaccgacaaggagaagcccgtgaacatcgagaccgagcccccgttcggcgagtcctacatcgtggtcggcgccggggagaaggcgctgaagctgagctggttcaagaagggctccagcatcgggaagatgttcgaggccacggcccggggcgcccgccggatggccatcctcggggacaccgcgtgggacttcggctccatcggcggggtgttcaccagcgtgggcaagctggtccaccaggtgttcgggaccgcctacggcgtgctgttctccggggtcagctggacgatgaagatcggcatcggcatcctcctgacctggctggggctcaactcccgcagcacctccctgagcatgacctgcatcgtggtgggcatcgtcacgctgtacctcggggtgatggtgcaggccgactccggctgcgtcatcaactggaaggggcgcgagctgaagtgcggcagcggcatcttcgtgaccaacgaggtgcacacctggaccgagcagtacaagttccaggccgactcccccaagcggctgagcgccgcgatcgggaaggcctgggaggagggcgtctgcgggatccgcagcgccacccggctcgagaacatcatgtggaagcagatctccaacgagctgaaccacatcctgctcgagaacgacatgaagttcacggtggtggtcggcgacgccaacgggatcctggcccagggcaagaagatgatccgcccccagcccatggagcacaagtacagctggaagtcctggggcaaggcgaagatcatcggggccgacacccagaacaccaccttcatcatcgacggcccggacacgcccgagtgccccgacaaccagcgggcctggaacatctgggaggtggaggactacgggttcggcatcttcaccaccaacatctggctgaagctccgcgacagctacacccagatgtgcgaccaccggctgatgtccgccgcgatcaaggacagcaaggccgtgcacgccgacatgggctactggatcgagtccgagaagaacgagacgtggaagctggcccgcgccagcttcatcgaggtcaagacctgcacctggcccaagtcccacaccctctggagcaacggggtgctggagtccgagatgatcatcccgaagatctacggcgggcccatcagccagcacaactaccggcccggctacttcacgcagaccgcggggccgtggcacctgggcaagctcgagctggacttcgacctgtgcgagggcaccaccgtggtcgtggacgagcactgcgggaaccgcggcccctccctccggacgaccaccgtgaccgggaagatcatccacgagtggtgctgccgcagctgcacgctgccgcccctgcggttccgcggcgaggacgggtgctggtacggcatggagatccggccggtcaaggagaaggaggagaacctcgtgcgctccatggtgagcgccggctccggggaggtcgacagcttcagcctgggcatcctgtgcgcctccatcatgatcgaggaggtgatgcggagccgctggtcccggaagatgctcatgaccgggaccctggccgtgttcctgctcctgatcatgggccagctgacctggaaggacctcatccgcctgtgcatcatggtcggggccaacgcgagcgaccgcatgggcatgggcacgacctacctggccctcatggccaccttcaagatgcggcccatgttcgccgtggggctgctgttccgccggctcacctcccgcgaggtgctgctgctcacgatcggcctgagcctggtcgcctccgtggagctccccaacagcctggaggagctgggggacggcctcgcgatgggcatcatgatgctgaagctgctcaccgagttccagccccaccagctgtggaccaccctgctctccctgacgttcatcaagaccaccctgagcctcgactacgcctggaagaccacggccatggccctgtccatcgtcagcctgttcccgctctgcctgtccaccaccagccagaagaccacctggctgcccgtgctcctggggtccttcggctgcaagcccagcacgatgttcctgatcaccgagaacaagatctgggggcggaagtcctggcccctcaacgagggcatcatggcgatcgggatcgtgagcatcctgctgtccagcctcctgaagaacgacgtcccgctggccggccccctcatcgccggcgggatgctgatcgcctgctacgtgatcagcggctccagcgccgacctgtccctcgagaaggcggccgaggtgagctgggagcaggaggccgagcactccgggaccagccacaacatcctggtcgaggtgcaggacgacggcaccatgaagatcaaggacgaggagcgcgacgacacgctgaccatcctcctgaaggccaccctgctcgccgtgtccggggtctaccccatgagcatccccgcgaccctgttcgtgtggtacttctggcagaagaagaagcagcggtccggcgtgctgtgggacacgccgtccccgcccgaggtcgagcgcgccgtgctcgacgacggcatctaccggatcctgcagcgcgggctgctgggccggtcccaggtgggggtcggcgtgttccaggacggggtgttccacaccatgtggcacgtcacccgcggcgccgtgctcatgtaccagggcaagcggctggagcccagctgggcctccgtgaagaaggacctgatcagctacgggggcgggtggcgcttccagggctcctggaacaccggggaggaggtccaggtgatcgccgtggagccgggcaagaaccccaagaacgtccagacgacccccggcaccttcaagacccccgagggggaggtgggcgcgatcgccctcgacttcaagccggggacgagcggctcccccatcgtgaaccgggagggcaagatcgtcgggctgtacggcaacggggtggtgaccaccagcggcacctacgtctccgccatcgcccaggccaaggcgagccaggaggggcccctgccggagatcgaggacgaggtgttcaagaagcgcaacctcacgatcatggacctgcaccccggcagcggcaagacccggcgctacctgcccgccatcgtgcgggaggccatcaagcgcaagctccggaccctgatcctggcccccacccgcgtcgtggcgtccgagatggccgaggccctcaaggggatgccgatccgctaccagacgaccgccgtcaagagcgagcacaccggccgggagatcgtcgacctgatgtgccacgccaccttcacgatgcgcctgctctcccccgtgcgggtgcccaactacaacatgatcatcatggacgaggcgcacttcaccgaccccgccagcatcgccgcccgcgggtacatctccacccgggtcggcatgggggaggccgcggccatcttcatgaccgccacgccgcccggcagcgtggaggccttcccccagtccaacgccgtgatccaggacgaggagcgcgacatccccgagcggagctggaactccggctacgactggatcaccgacttcccggggaagaccgtctggttcgtgcccagcatcaagtccggcaacgacatcgcgaactgcctgcgcaagaacgggaagcgggtgatccagctgagccgcaagaccttcgacacggagtaccagaagaccaagaacaacgactgggactacgtcgtgaccaccgacatctccgagatgggcgccaacttccgggccgaccgcgtgatcgacccccggcgctgcctcaagcccgtcatcctgaaggacgggccggagcgggtgatcctggccggccccatgcccgtgacggtcgcgagcgccgcccagcgccggggccgcatcgggcggaaccagaacaaggagggcgaccagtacgtgtacatggggcagcccctcaacaacgacgaggaccacgcccactggaccgaggccaagatgctgctggacaacatcaacaccccggagggcatcatccccgccctcttcgagcccgagcgcgagaagtccgccgccatcgacggggagtaccgcctgcggggcgaggcccgcaagaccttcgtcgagctgatgcggcgcggcgacctccccgtgtggctgagctacaaggtggcctccgaggggatccagtacagcgaccggcgctggtgcttcgacggcgagcggaacaaccaggtcctggaggagaacatggacgtggagatctggaccaaggagggggagcgcaagaagctccggccgcgctggctggacgcgcggacgtactccgaccccctggccctccgcgagttcaaggagttcgccgccggccggcgcagcgtgagcggcgacctgatcctggagatcgggaagctcccccagcacctgaccctgcgggcccagaacgcgctcgacaacctggtcatgctgcacaactccgagcagggcgggaaggcctaccgccacgccatggaggagctccccgacaccatcgagaccctgatgctgctcgccctgatcgcggtgctgacgggcggggtgaccctcttcttcctgagcggcaagggcctggggaagacctccatcggcctcctgtgcgtcaccgccagctccgccctgctctggatggccagcgtggagctgcactggatcgccgcgtccatcatcctggagttcttcctcatggtgctgctgatcccggagcccgaccggcagcgcacgccccaggacaaccagctcgcctacgtcgtgatcgggctgctgttcatgatcctcaccgtggccgccaacgagatgggcctgctggagaccaccaagaaggacctcgggatcggccacgtcgccgcggagaaccaccagcacgccacgatgctggacgtggacctgcggccggccagcgcctggaccctctacgccgtggcgaccaccgtcatcacgcccatgatgcgccacaccatcgagaacaccaccgccaacatctccctgacggccatcgccaaccaggccgcgatcctgatgggcctcgacaaggggtggcccatcagcaagatggacatcggcgtgcccctgctggccctcgggtgctactcccaggtgaacccgctgaccctgaccgccgccgtcctcatgctggtggcgcactacgccatcatcggccccgggctgcaggccaaggccacccgggaggcccagaagcgcacggcggccggcatcatgaagaaccccaccgtggacggcatcgtcgccatcgacctcgaccccgtggtgtacgacgccaagttcgagaagcagctggggcagatcatgctgctcatcctgtgcaccagccagatcctgctcatgcgcaccacgtgggccctgtgcgagtccatcaccctggcgaccggcccgctcaccacgctgtgggaggggagccccggcaagttctggaacaccaccatcgccgtctccatggccaacatcttccggggcagctacctggccggggccggcctcgcgttctccctgatgaagtccctcgggggcgggcgccgggggaccggcgcccagggggagacgctcggcgagaagtggaagcgccagctgaaccagctgtccaagagcgagttcaacatctacaagcggagcgggatcatggaggtggaccgctccgaggccaaggagggcctcaagcgcggggagaccaccaagcacgccgtgagccgcggcaccgcgaagctgcggtggttcgtcgagcgcaacctggtgaagcccgagggcaaggtgatcgacctggggtgcggccgcgggggctggtcctactactgcgccgggctcaagaaggtcaccgaggtgaagggctacacgaagggcgggcccggccacgaggagccgatccccatggccacctacgggtggaacctggtgaagctgcacagcggcaaggacgtcttcttcatgccgcccgagaagtgcgacaccctcctgtgcgacatcggggagtccagcccgaaccccaccatcgaggagggccgcacgctgcgggtgctcaagatggtggagccctggctgcgcggcaaccagttctgcatcaagatcctgaacccctacatgccgtccgtcgtggagaccctcgagcagatgcagcggaagcacgggggcatgctggtgcgcaaccccctgagccggaactccacccacgagatgtactgggtcagctgcgggaccggcaacatcgtgtccgccgtgaacatgacgagccgcatgctcctgaaccggttcaccatggcccaccgcaagcccacctacgagcgcgacgtcgacctgggcgcggggacccggcacgtggccgtggagcccgaggtcgccaacctcgacatcatcggccagcgcatcgagaacatcaagaacgagcacaagtccacgtggcactacgacgaggacaacccgtacaagacctgggcctaccacgggagctacgaggtgaagccctccggcagcgcctccagcatggtgaacggggtcgtgcggctgctgaccaagccctgggacgtcatccccatggtgacccagatcgcgatgacggacaccaccccgttcggccagcagcgcgtgttcaaggagaaggtcgacacccggacgccccgcgccaagcggggcaccacccagatcatggaggtgaccgccaagtggctctgggggttcctgtcccgcaacaagaagccccggatctgcacgcgcgaggagttcacccggaaggtgcgcagcaacgccgccatcggcgcggtcttcgtggacgagaaccagtggaacagcgccaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggcgaagggctcccgggccatctggtacatgtggctgggggcccgcttcctcgagttcgaggccctgggcttcatgaacgaggaccactggttcagccgggagaactccctgagcggggtggagggcgaggggctccacaagctgggctacatcctgcgcgacatctccaagatcccgggcgggaacatgtacgccgacgacaccgcgggctgggacacgcggatcaccgaggacgacctccagaacgaggccaagatcaccgacatcatggagcccgagcacgccctgctggccaccagcatcttcaagctcacgtaccagaacaaggtcgtgcgcgtgcagcgccccgccaagaacgggaccgtcatggacgtgatctcccggcgcgaccagcggggcagcggccaggtggggacctacggcctgaacaccttcacgaacatggaggtccagctgatccgccagatggagtccgaggggatcttcctccccagcgagctggagaccccgaacctggcggagcgggtgctcgactggctggagaagcacggcgccgagcgcctgaagcggatggccatctccggggacgactgcgtggtcaagcccatcgacgaccgcttcgccaccgccctcaccgcgctgaacgacatgggcaaggtgcggaaggacatcccccagtgggagcccagcaagggctggaacgactggcagcaggtcccgttctgctcccaccacttccaccagctgatcatgaaggacgggcgcgagatcgtcgtgccctgccggaaccaggacgagctcgtgggccgcgcccgggtcagccagggggccggctggtccctgcgcgagaccgcctgcctgggcaagagctacgcccagatgtggcagctcatgtacttccaccggcgcgacctgcggctggcggccaacgccatctgctccgccgtgcccgtggactgggtccccacgagccgcaccacctggagcatccacgcgcaccaccagtggatgaccacggaggacatgctctccgtgtggaaccgggtgtggatcgaggagaacccgtggatggaggacaagacccacgtcagctcctgggaggaggtgccctacctgggcaagcgcgaggaccagtggtgcggcagcctgatcgggctcaccgcccgcgccacctgggccacgaacatccaggtggccatcaaccaggtccggcgcctgatcggcaacgagaactacctggactacatgacctccatgaagcggttcaagaacgagagcgaccccgagggggcgctctggtga

SEQ ID NO: 8119 - RNA, 9879 nt, synthetic construct
  misc_feature 1..9879: note = derived and/or modified CDS sequence (opt1) from DENV-1__KJ189343__SS-prME
  source 1..9879: mol_type = other RNA
agcgtgaccatgctgctcatgctgctgcccaccgccctcgccttccacctgacgacccggggcggggagccccacatgatcgtgagcaagcaggagcggggcaagagcctcctgttcaagaccagcgcgggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtcacctacgggacctgcagccagaccggcgagcaccgccgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgaccgccctgttcctcgcgcacgccatcggcaccagcatcacccagaaggggatcatcttcatcctgctgatgctcgtgacgccctccatggccatgcgctgcgtcggcatcggcaaccgggacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgcgatcctccgcaagctgtgcatcgaggccaagatcagcaacaccacgaccgactcccggtgccccacccagggcgaggccaccctggtggaggagcaggacgccaacttcgtgtgccgccggacgttcgtcgaccgcggctgggggaacggctgcggcctcttcggcaaggggagcctgctgacctgcgccaagttcaagtgcgtgaccaagctcgagggcaagatcgtgcagtacgagaacctgaagtactccgtcatcgtgaccgtgcacacgggcgaccagcaccaggtcgggaacgagaccaccgagcacggcaccatcgcgaccatcacgccccaggcccccaccagcgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggacctccggggccagcaccagccaggagacgtggaaccgccaggacctcctggtgaccttcaagaccgcccacgcgaagaagcaggaggtggtcgtgctgggctcccaggagggcgccatgcacaccgccctcacgggggccaccgagatccagaccagcggcaccacgaccatcttcgccgggcacctgaagtgccggctgaagatggacaagctcaccctgaagggcacctcctacgtgatgtgcacggggagcttcaagctggagaaggaggtcgcggagacccagcacggcaccgtgctggtgcaggtcaagtacgagggcaccgacgccccctgcaagatccccttctccacgcaggacgagaagggggtgacccagaacggccgcctcatcaccgccaacccgatcgtgaccgacaaggagaagcccgtcaacatcgagacggagccgcccttcggggagagctacatcgtggtgggcgccggcgagaaggcgctgaagctgtcctggttcaagaaggggagctccatcggcaagatgttcgaggccaccgcccgcggggcccgccggatggccatcctcggcgacaccgcgtgggacttcgggagcatcggcggcgtcttcacctccgtggggaagctggtgcaccaggtcttcggcacggcctacggggtgctgttcagcggcgtgtcctggaccatgaagatcgggatcggcatcctcctgacctggctgggcctcaacagccgctccaccagcctgtccatgacgtgcatcgccgtcgggatggtgaccctgtacctcggcgtgatggtccaggccgacagcgggtgcgtggtgaactggaagggccgcgagctgaagtgcgggtccggcatcttcgtcaccaacgaggtgcacacctggaccgagcagtacaagttccaggccgacagcccgaagcggctgagcgcggccatcggcaaggcctgggaggagggggtgtgcggcatccgctccgccacgcggctcgagaacatcatgtggaagcagatcagcaacgagctgaaccacatcctgctcgagaacgacatgaagttcaccgtcgtggtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacacgccggagtgccccgacaaccagcgggcctggaacatctgggaggtcgaggactacggcttcgggatcttcaccaccaacatctggctgaagctccgcgactcctacacccagatgtgcgaccaccggctgatgagcgcggccatcaaggactccaaggccgtgcacgccgacatgggctactggatcgagagcgagaagaacgagacgtggaagctggcccgcgcgtccttcatcgaggtgaagacctgcacctggcccaagagccacaccctctggtccaacggcgtcctggagagcgagatgatcatccccaagatctacgggggcccgatctcccagcacaactaccggcccgggtacttcacgcagaccgccggcccctggcacctggggaagctcgagctggacttcgacctgtgcgagggcaccaccgtggtggtcgacgagcactgcggcaaccgcgggccgagcctccggacgaccaccgtgaccggcaagatcatccacgagtggtgctgccgctcctgcacgctgccgcccctgcggttccgcggggaggacggctgctggtacgggatggagatccggcccgtgaaggagaaggaggagaacctcgtccgcagcatggtgtccgccggcagcggcgaggtggacagcttctccctggggatcctgtgcgccagcatcatgatcgaggaggtcatgcggtcccgctggagccggaagatgctcatgatcggcaccctggccgtgttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtcggcctgctgttccgccggctcaccagccgcgaggtgctgctgctcaccatcgggctgtccctggtggcgagcgtcgagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtgtccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggccatcggcatcgtgagcatcctgctctccagcctgctgaagaacgacgtgcccctcgccgggccgctgatcgccggcggcatgctgatcgcctgctacgtcatcagcgggtccagcgcggacctctccctggagaagaccgccgaggtgagctgggagcaggaggccgagcactccggcaccagccacaacatcctggtggaggtccaggacgacgggaccatgaagatcaaggacgaggagcgcgacgacacgctcaccatcctgctgaaggccaccctcctggccgtgtccggcgtgtaccccatgagcatccccgcgaccctgttcgtctggtacttctggcagaagaagaagcagcggtccggggtgctctgggacacgcccagcccgcccgaggtggagcgcgccgtcctggacgacggcatctaccggatcctgcagcgcggcctgctcgggcggtcccaggtgggcgtgggggtcttccaggacggcgtgttccacaccatgtggcacgtgacccgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgccgtggagcccgggaagaacccgaagaacgtgcagacgacccccggcaccttcaagacccccgagggcgaggtcggggcgatcgccctggacttcaagcccggcacgagcgggtccccgatcgtgaaccgggagggcaagatcgtgggcctgtacgggaacggcgtcgtgaccaccagcgggacctacgtgtccgccatcgcccaggccaaggcgagccaggagggccccctccccgagatcgaggacgaggtcttcaagaagcgcaacctgacgatcatggacctgcacccggggagcggcaagacccggcgctacctccccgccatcgtgcgggaggccatcaagcgcaagctgcggaccctgatcctcgcccccacccgcgtggtcgcgtccgagatggccgaggccctgaagggcatgcccatccgctaccagacgaccgccgtcaagagcgagcacaccgggcgggagatcgtggacctgatgtgccacgccaccttcacgatgcgcctcctgtccccggtccgggtgcccaactacaacatgatcatcatggacgaggcgcacttcaccgaccccgccagcatcgccgcccgcggctacatctccacccgggtggggatgggcgaggccgcggccatcttcatgaccgccacgcccccggggagcgtcgaggccttcccccagtccaacgccgtgatccaggacgaggagcgcgacatccccgagcggagctggaactccggctacgactggatcaccgacttccccggcaagaccgtgtggttcgtcccgagcatcaagtccgggaacgacatcgcgaactgcctgcgcaagaacggcaagcgggtgatccagctcagccgcaagaccttcgacacggagtaccagaagaccaagaacaacgactgggactacgtggtcaccaccgacatctccgagatgggggccaacttccgggccgaccgcgtgatcgacccccggcgctgcctgaagcccgtgatcctgaaggacggccccgagcgggtcatcctcgccgggccgatgcccgtgacggtggcgagcgccgcccagcgccggggccgcatcggccggaaccagaacaaggagggggaccagtacgtctacatgggccagcccctgaacaacgacgaggaccacgcccactggaccgaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcctccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcgcggacgtactccgacccgctcgccctgcgcgagttcaaggagttcgccgccgggcggcgcagcgtgagcggcgacctgatcctcgagatcggcaagctgccccagcacctgaccctccgggcccagaacgcgctggacaacctggccatgctccacaactccgagcagggcgggaaggcctaccgccacgccatggaggagctgcccgacaccatcgagaccctgatgctcctggcgctgatcgccgtgctcaccggcggggtcaccctgttcttcctgagcgggaaggggctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcaccgtcgccgccaacgagatggggctgctggagaccaccaagaaggacctcggcatcgggcacgtggcggccgagaaccaccagcacgccacgatgctggacgtggacctgcggccggccagcgcctggaccctctacgcggtcgccaccaccgtgatcacgcccatgatgcgccacaccatcgagaacaccaccgccaacatctccctgacggccatcgccaaccaggcggccatcctgatgggcctcgacaagggctggcccatcagcaagatggacatcggggtgcccctgctggccctcggctgctactcccaggtcaacccgctgaccctgaccgccgcggtgctcatgctggtggcccactacgccatcatcgggcccggcctgcaggccaaggccacccgggaggcgcagaagcgcacggccgccgggatcatgaagaaccccaccgtcgacggcatcgtggccatcgacctcgaccccgtggtctacgacgccaagttcgagaagcagctgggccagatcatgctgctcatcctgtgcaccagccagatcctgctcatgcgcaccacgtgggcgctgtgcgagtccatcaccctggccaccgggccgctcaccacgctgtgggagggcagccccgggaagttctggaacaccaccatcgccgtgtccatggccaacatcttccggggcagctacctggccggcgcggggctcgccttctccctgatgaagtccctgggcgggggccgccgggggaccggcgcccagggcgagacgctcggggagaagtggaagcgccagctgaaccagctgtccaagagcgagttcaacacctacaagcggagcggcatcatggaggtggaccgctccgaggccaaggaggggctcaagcggggcgagaccaccaagcacgcggtcagccgcgggaccgccaagctgcggtggttcgtggagcgcaacctggtgaagcccgagggcaaggtcatcgacctgggctgcgggcggggcgggtggtcctactactgcgccggcctcaagaaggtgacggaggtgaaggggtacaccaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccacgatcgaggaggggcgcaccctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacccacgagatgtactgggtgagctgcggcacggggaacatcgtgtccgccgtcaacatgaccagccgcatgctcctgaaccggttcaccatggcgcaccgcaagcccaccttcgagcgcgacgtggacctgggcgccggcacgcggcacgtggccgtcgagcccgaggtggccaacctcgacatcatcgggcagcgcatcgagaacatcaagaacgagcacaagtccacctggcactacgacgaggacaacccgtacaagacctgggcctaccacggcagctacgaggtgaagccctccgggagcgcgtccagcatggtcaacggcgtggtgcggctgctgaccaagccctgggacgtcatccccatggtgacgcagatcgccatgaccgacaccaccccgttcgggcagcagcgcgtcttcaaggagaaggtggacacgcggacgccccgggccaagcggggcaccacccagatcatggaggtgacggccaagtggctctggggcttcctgtcccgcaacaagaagccccggatctgcacccgcgaggagttcacccggaaggtccgcagcaacgccgcgatcggggccgtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgcggacgacacggccgggtgggacacccggatcaccgaggacgacctccagaacgaggccaagatcaccgacatcatggagcccgagcacgccctgctggccacgagcatcttcaagctcacctaccagaacaaggtggtgcgcgtccagcgccccgcgaagaacggcaccgtgatggacgtgatctcccggcgcgaccagcgggggagcggccaggtcggcacctacgggctgaacacgttcaccaacatggaggtgcagctgatccgccagatggagtccgagggcatcttcctccccagcgagctggagaccccgaacctggccgagcgggtgctcgactggctggagaagcacggggccgagcgcctgaagcggatggccatctccggcgacgactgcgtcgtgaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagacggcctgcctgggcaagagctacgcgcagatgtggcagctcatgtacttccaccggcgcgacctgcggctggccgccaacgccatctgctccgcggtgcccgtcgactgggtgcccaccagccgcaccacctggagcatccacgcccaccaccagtggatgacgaccgaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcaccgcccgcgccacgtgggccaccaacatccaggtcgcgatcaaccaggtgcggcgcctgatcgggaacgagaactacctggactacatgacctccatgaagcggttcaagaacgagagcgaccccgagggcgccctctggtga

SEQ ID NO: 8120 - RNA, 9879 nt, synthetic construct
  misc_feature 1..9879: note = derived and/or modified CDS sequence (opt1) from DENV-1__KJ189344__SS-prME
  source 1..9879: mol_type = other RNA
agcgtgacgatgctgctcatgctgctgcccaccgccctcgccttccacctgacgacccggggcggggagccccacatgatcgtgagcaagcaggagcggggcaagagcctcctgttcaagaccagcgcgggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgaccgccctgttcctcgcgcacgccatcggcaccagcatcacccagaaggggatcatcttcatcctgctgatgctcgtgacgccctccatggccatgcgctgcgtcggcatcggcaaccgggacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgcgatcctccgcaagctgtgcatcgaggccaagatcagcaacaccacgaccgactcccggtgccccacccagggcgaggccaccctggtggaggagcaggacgccaacttcgtgtgccgccggacgttcgtcgaccgcggctgggggaacggctgcggcctcttcggcaaggggagcctgctgacctgcgccaagttcaagtgcgtgaccaagctcgagggcaagatcgtgcagtacgagaacctgaagtactccgtcatcgtgaccgtgcacacgggcgaccagcaccaggtcgggaacgagaccaccgagcacggcaccatcgcgaccatcacgccccaggcccccaccagcgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggacctccggggccagcaccagccaggagacgtggaaccgccaggacctcctggtgaccttcaagaccgcccacgcgaagaagcaggaggtggtcgtgctgggctcccaggagggcgccatgcacaccgccctcacgggggccaccgagatccagaccagcggcaccacgaccatcttcgccgggcacctgaagtgccggctgaagatggacaagctcaccctgaagggcacctcctacgtgatgtgcacggggagcttcaagctggagaaggaggtcgcggagacccagcacggcaccgtgctggtgcaggtcaagtacgagggcaccgacgccccctgcaagatccccttctccacgcaggacgagaagggggtgacccagaacggccgcctcatcaccgccaacccgatcgtgaccgacaaggagaagcccgtcaacatcgagacggagccgcccttcggggagagctacatcgtggtgggcgccggcgagaaggcgctgaagctgtcctggttcaagaaggggagctccatcggcaagatgttcgaggccaccgcccgcggggcccgccggatggccatcctcggcgacaccgcgtgggacttcgggagcatcggcggcgtcttcacctccgtggggaagctggtgcaccaggtcttcggcacggcctacggggtgctgttcagcggcgtgtcctggaccatgaagatcgggatcggcatcctcctgacctggctgggcctcaacagccgctccaccagcctgtccatgacgtgcatcgccgtcgggatggtgaccctgtacctcggcgtgatggtccaggccgacagcgggtgcgtggtgaactggaagggccgcgagctgaagtgcgggtccggcatcttcgtcaccaacgaggtgcacacctggaccgagcagtacaagttccaggccgacagcccgaagcggctgagcgcggccatcggcaaggcctgggaggagggggtgtgcggcatccgctccgccacgcggctcgagaacatcatgtggaagcagatcagcaacgagctgaaccacatcctgctcgagaacgacatgaagttcaccgtcgtggtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacacgccggagtgccccgacaaccagcgggcctggaacatctgggaggtcgaggactacggcttcgggatcttcaccaccaacatctggctgaagctccgcgactcctacacccagatgtgcgaccaccggctgatgagcgcggccatcaaggactccaaggccgtgcacgccgacatgggctactggatcgagagcgagaagaacgagacgtggaagctggcccgcgcgtccttcatcgaggtgaagacctgcacctggcccaagagccacaccctctggtccaacggcgtcctggagagcgagatgatcatccccaagatctacgggggcccgatctcccagcacaactaccggcccgggtacttcacgcagaccgccggcccctggcacctggggaagctcgagctggacttcgacctgtgcgagggcaccaccgtggtggtcgacgagcactgcggcaaccgcgggccgagcctccggacgaccaccgtgaccggcaagatcatccacgagtggtgctgccgctcctgcacgctgccgcccctgcggttccgcggggaggacggctgctggtacgggatggagatccggcccgtgaaggagaaggaggagaacctcgtccgcagcatggtgtccgccggcagcggcgaggtggacagcttctccctggggatcctgtgcgtcagcatcatgatcgaggaggtgatgcggtcccgctggagccggaagatgctcatgaccggcaccctggccgtgttcctgctcctggtcatggggcagctgacctggaacgacctcatccgcctgtgcatcatggtgggcgccaacgcgtccgaccgcatggggatgggcacgacctacctggccctcatggccaccttcaagatgcggccgatgttcgccgtgggcctgctgttccgccggctcaccagccgcgaggtcctgctgctcacgatcgggctgtccctggtggccagcgtcgagctccccaactccctggaggagctgggcgacgggctcgcgatgggcatcatgatgctgaagctgctcaccgagttccagccccaccagctgtggaccaccctgctcagcctgacgttcatcaagaccaccctgtccctcgactacgcctggaagaccacggccatggccctgagcatcgtgtccctgttccccctctgcctgagcaccacctcccagaagaccacctggctgccggtgctcctgggcagcttcgggtgcaagcccctgacgatgttcctcatcaccgagaacaagatctggggccggaagtcctggcccctgaacgaggggatcatggcgatcggcatcgtcagcatcctgctctccagcctgctgaagaacgacgtgcccctcgccgggccgctgatcgccggcggcatgctgatcgcctgctacgtgatcagcgggtccagcgccgacctctccctggagaaggcggccgaggtcagctgggagcaggaggccgagcactccggcaccagccacaacatcctggtggaggtgcaggacgacgggaccatgaagatcaaggacgaggagcgcgacgacacgctcaccatcctgctgaaggccaccctcctggccgtctccggcgtgtaccccatgagcatccccgcgaccctgttcgtgtggtacttctggcagaagaagaagcagcggtccggggtcctctgggacacgcccagcccgcccgaggtggagcgcgccgtgctggacgacggcatctaccggatcctgcagcgcggcctgctcgggcggtcccaggtcggcgtgggggtgttccaggacggcgtcttccacaccatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgccgtcgagcccgggaagaacccgaagaacgtgcagacgacccccggcaccttcaagacccccgagggcgaggtgggggcgatcgccctggacttcaagcccggcacgagcgggtccccgatcgtcaaccgggagggcaagatcgtgggcctgtacgggaacggcgtggtcaccaccagcgggacctacgtgtccgccatcgcccaggccaaggcgagccaggagggccccctccccgagatcgaggacgaggtgttcaagaagcgcaacctgacgatcatggacctgcacccggggagcggcaagacccggcgctacctccccgccatcgtccgggaggccatcaagcgcaagctgcggaccctgatcctcgcccccacccgcgtggtggcgtccgagatggccgaggccctgaagggcatgcccatccgctaccagacgaccgccgtcaagagcgagcacaccgggcgggagatcgtggacctgatgtgccacgccaccttcacgatgcgcctcctgtccccggtgcgggtccccaactacaacatgatcatcatggacgaggcgcacttcaccgaccccgccagcatcgccgcccgcggctacatctccacccgggtggggatgggcgaggccgcggccatcttcatgaccgccacgcccccggggagcgtggaggccttcccccagtccaacgccgtcatccaggacgaggagcgcgacatccccgagcggagctggaactccggctacgactggatcaccgacttccccggcaagaccgtgtggttcgtgccgagcatcaagtccgggaacgacatcgcgaactgcctgcgcaagaacggcaagcgggtcatccagctcagccgcaagaccttcgacacggagtaccagaagaccaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgccgggccgatgcccgtcacggtggcgagcgccgcccagcgccggggccgcatcggccggaaccagaacaaggagggggaccagtacgtctacatgggccagcccctgaacaacgacgaggaccacgcccactggaccgaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtggagctcatgcggcgcggcgacctgcccgtgtggctgagctacaaggtcgcctccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcgcggacgtactccgacccgctcgccctgcgcgagttcaaggagttcgccgccgggcggcgcagcgtcagcggcgacctgatcctcgagatcggcaagctgccccagcacctgaccctccgggcccagaacgcgctggacaacctggtgatgctccacaactccgagcagggcgggaaggcctaccgccacgccatggaggagctgcccgacaccatcgagaccctgatgctcctggccctgatcgcggtgctcaccggcggggtcaccctgttcttcctgagcgggaaggggctcggcaagacctccatcgggctgctgtgcgtgaccgccagctccgccctcctgtggatggccagcgtggagccccactggatcgccgcgtccatcatcctggagttcttcctcatggtcctgctgatcccggagcccgaccggcagcgcacgccccaggacaaccagctcgcctacgtggtgatcggcctgctgttcatgatcctcaccgtcgccgccaacgagatggggctgctggagaccaccaagaaggacctcggcatcgggcacgtggccgcggagaaccaccagcacgccacgatgctggacgtggacctgcggccggccagcgcctggaccctctacgccgtcgcgaccaccgtgatcacgcccatgatgcgccacaccatcgagaacaccaccgccaacatctccctgacggccatcgccaaccaggccgcgatcctgatgggcctcgacaagggctggcccatcagcaagatggacatcggggtgcccctgctggccctcggctgctactcccaggtcaacccgctgaccctgaccgccgccgtgctcatgctggtggcgcactacgccatcatcgggcccggcctgcaggccaaggccacccgggaggcccagaagcgcacggcggccgggatcatgaagaaccccaccgtcgacggcatcgtggccatcgacctcgaccccgtggtctacgacgccaagttcgagaagcagctgggccagatcatgctgctcatcctgtgcaccagccagatcctgctcatgcgcaccacgtgggccctgtgcgagtccatcaccctggcgaccgggccgctcaccacgctgtgggagggcagccccgggaagttctggaacaccaccatcgccgtgtccatggccaacatcttccggggcagctacctggccggcgccgggctcgcgttctccctgatgaagtccctgggcgggggccgccgggggaccggcgcccagggcgagacgctcggggagaagtggaagcgccagctgaaccagctgtccaagagcgagttcaacacctacaagcggagcggcatcatggaggtggaccgctccgaggccaaggaggggctcaagcggggcgagaccaccaagcacgccgtcagccgcgggaccgcgaagctgcggtggttcgtggagcgcaacctggtgaagcccgagggcaaggtcatcgacctgggctgcgggcggggcgggtggtcctactactgcgccggcctcaagaaggtgacggaggtgaaggggtacaccaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccacgatcgaggaggggcgcaccctgcgggtgctcaagatggtcgagccctggctgcgcggcaaccagttctgcatcaagatcctgaacccctacatgccgtccgtggtggaggccctcgagcagatgcagcggaagcacggcgggatgctggtccgcaaccccctgagccggaactccacccacgagatgtactgggtgagctgcggcaccgggaacatcgtgtccgccgtcaacatgacgagccgcatgctcctgaaccggttcaccatggcgcaccgcaagcccacctacgagcgcgacgtggacctgggcgccggcacccggcacgtggccgtcgagcccgaggtggccaacctcgacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtcaacggcgtggtccggctgctgaccaagccctgggacgtgatccccatggtgacccagatcgccatgacggacaccaccccgttcgggcagcagcgcgtcttcaaggagaaggtggacacccggacgccccgcgccaagcggggcaccacccagatcatggaggtgaccgccaagtggctctggggcttcctgtcccgcaacaagaagccccggatctgcacgcgcgaggagttcacccggaaggtccgcagcaacgccgcgatcggggccgtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgcggacgacaccgccgggtgggacacgcggatcaccgaggacgacctccagaacgaggccaagatcaccgagatcatggagcccgagcacgccctgctggccaccagcatcttcaagctcacgtaccagaacaaggtggtgcgcgtccagcgccccgcgaagaacggcaccgtgatggacgtgatctcccggcgcgaccagcgggggagcggccaggtcggcacctacgggctgaacaccttcacgaacatggaggtgcagctgatccgccagatggagtccgagggcatcttcctccccagcgagctggagaccccgaacctggccgagcgggtgctcgactggctggagaagcacggggccgagcgcctgaagcggatggccatctccggcgacgactgcgtcgtgaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgctccgcggtgcccgtcgactgggtgcccacgagccgcaccacctggagcatccacgcccaccaccagtggatgaccacggaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcaccgcccgcgccacctgggccacgaacatccaggtcgcgatcaaccaggtgcggcgcctgatcgggaacgagaactacctggactacatgacctccatgaagcggttcaagaacgagagcgaccccgagggcgccctctggtga

SEQ ID NO: 8121 - RNA, 9879 nt, synthetic construct
  misc_feature 1..9879: note = derived and/or modified CDS sequence (opt1) from DENV-1__KJ189346__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagacctccgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagatgagcggcaccaccaccatcttcgccgggcacctgaagtgccggctgaagatggacaagctcacgctgaagggcacctcctacgtgatgtgcaccgggagcttcaagctggagaaggaggtcgcggagacccagcacggcacggtgctggtgcaggtcaagtacgagggcaccgacgccccctgcaagatccccttctccacccaggacgagaagggggtgacccagaacggccgcctcatcacggccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtcttcacctccgtggggaagctggtgcaccaggtcttcggcaccgcctacggggtgctgttcagcggcgtgtcctggaccatgaagatcgggatcggcatcctcctgacgtggctgggcctcaacagccgctccaccagcctgtccatgacctgcatcgccgtcgggatggtgaccctgtacctcggcgtgatggtccaggccgacagcgggtgcgtgatcaactggaagggccgcgagctgaagtgcgggtccggcatcttcgtgacgaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcaccgtggtcgtgggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacaaccagcgggcctggaacatctgggaggtggaggactacggcttcgggatcttcaccacgaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacctgcacgtggcccaagagccacaccctctggtccaacggcgtgatggagagcgagatgatcatccccaagatctacgggggcccgatctcccagcacaactaccggcccgggtacttcacccagaccgccggcccctggcacctggggaagctggagctcgacttcgacctgtgcgagggcacgaccgtcgtggtggacgagcactgcggcaaccgcgggccgagcctgcggaccaccacggtcaccggcaagatcatccacgagtggtgctgccgctcctgcaccctgccgcccctgcggttccgcggggaggacggctgctggtacgggatggagatccggcccgtgaaggagaaggaggagaacctggtgcgcagcatggtctccgccggcagcggcgaggtggacagcttctccctcgggatcctgtgcgccagcatcatgatcgaggaggtgatgcggtcccgctggagccggaagatgctgatgaccggcacgctcgccgtcttcctgctgctcgtgatggggcagctgacctggaacgacctgatccgcctctgcatcatggtgggcgcgaacgcctccgaccgcatggggatgggcaccacctacctggccctgatggccacgttcaagatgcggccgatgttcgccgtcgggctcctgttccgccggctgaccagccgcgaggtgctcctgctgaccatcgggctctccctggtggcgagcgtcgagctgcccaactccctcgaggagctgggcgacgggctggccatgggcatcatgatgctcaagctgctgaccgagttccagccccaccagctctggacgaccctgctgagcctcaccttcatcaagaccacgctgtccctggactacgcctggaagaccaccgccatggcgctcagcatcgtgtccctgttccccctgtgcctcagcaccacgtcccagaagaccacctggctgccggtcctgctcggcagcttcgggtgcaagcccctgaccatgttcctgatcaccgagaacaagatctggggccggaagtcctggcccctcaacgaggggatcatggccatcggcatcgtgagcatcctgctgtccagcctcctgaagaacgacgtgcccctggccgggccgctcatcgccggcggcatgctgatcgcctgctacgtcatcagcgggtccagcgcggacctgtccctcgagaaggccgccgaggtgagctgggagcaggaggccgagcactccggcacgagccacaacatcctggtggaggtccaggacgacgggaccatgaagatcaaggacgaggagcgcgacgacaccctgaccatcctcctgaaggccacgctgctcgcggtgtccggcgtgtaccccatgagcatccccgccaccctgttcctgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacaccatgtggcacgtgacgcgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacccccggcacgttcaagacccccgagggcgaggtgggggccatcgccctggacttcaagcccggcaccagcgggtccccgatcgtcaaccgggagggcaagatcgtgggcctgtacgggaacggcgtggtcaccacgagcgggacctacgtgtccgccatcgcccaggcgaaggccagccaggagggccccctccccgagatcgaggacgaggtgttcaagaagcgcaacctgaccatcatggacctgcacccggggagcggcaagacccggcgctacctccccgccatcgtccgggaggccatcaagcgcaagctgcggacgctgatcctcgcgcccacccgcgtggtggcctccgagatggccgaggccctgaagggcatgcccatccgctaccagaccaccgccgtcaagagcgagcacacggggcgggagatcgtggacctgatgtgccacgcgaccttcaccatgcgcctcctgtccccggtgcgggtccccaactacaacatgatcatcatggacgaggcccacttcaccgaccccgccagcatcgccgcccgcggctacatctccacgcgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcaccgacttccccggcaagacggtgtggttcgtgcccagcatcaagtccgggaacgacatcgccaactgcctgcgcaagaacggcaagcgggtcatccagctcagccgcaagaccttcgacaccgagtaccagaagaccaagaacaacgactgggactacgtggtgacgaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggaccgaggcgaagatgctgctcgacaacatcaacacgcccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacctcccgggcgcagaacgccctcgacaacctggtgatgctgcacaacagcgagcagggcgggaaggcctaccgccacgccatggaggagctccccgacacgatcgagaccctgatgctgctcgcgctgatcgccgtgctgaccgggggcgtcaccctcttcttcctgtccgggaagggcctgggcaagacgagcatcgggctcctgtgcgtgaccgcctccagcgccctgctctggatggcctccgtggagccccactggatcgcggccagcatcatcctggagttcttcctgatggtcctcctgatcccggagcccgaccggcagcgcacgccccaggacaaccagctggcctacgtggtgatcggcctcctgttcatgatcctgaccgtcgccgccaacgagatggggctcctggagacgaccaagaaggacctgggcatcgggcacgtggcggccgagaaccaccagcacgccaccatgctcgacgtggacctgcggccggcctccgcctggaccctgtacgcggtcgccacgaccgtgatcacccccatgatgcgccacaccatcgagaacacgaccgccaacatcagcctcaccgccatcgccaaccaggcggccatcctgatgggcctggacaagggctggcccatctccaagatggacatcggggtgcccctcctggccctgggctgctacagccaggtcaacccgctcaccctgacggccgcggtgctgatgctcgtggcccactacgccatcatcgggcccggcctgcaggccaaggccacccgggaggcgcagaagcgcaccgccgccgggatcatgaagaaccccaccgtcgacggcatcgtggccatcgacctggaccccgtggtctacgacgccaagttcgagaagcagctcggccagatcatgctgctgatcctctgcacgtcccagatcctgctgatgcgcaccacctgggcgctctgcgagagcatcaccctggccacggggccgctgaccaccctctgggagggctcccccgggaagttctggaacaccacgatcgccgtgagcatggccaacatcttccggggctcctacctggccggcgcggggctggccttcagcctcatgaagtccctgggcgggggccgccgggggaccggcgcccagggcgagaccctgggggagaagtggaagcgccagctcaaccagctgagcaagagcgagttcaacacctacaagcggtccggcatcatggaggtggaccgcagcgaggccaaggaggggctgaagcggggcgagacgaccaagcacgcggtctcccgcgggaccgccaagctccggtggttcgtggagcgcaacctggtgaagcccgagggcaaggtcatcgacctgggctgcgggcggggcgggtggagctactactgcgccggcctgaagaaggtgaccgaggtgaaggggtacaccaagggcggccccgggcacgaggagccgatccccatggccacgtacggctggaacctcgccaagctgcactccgggaaggacgtcttcttcatgccgcccgagaagtgcgacaccctgctctgcgacatcggcgagagctccccgaaccccaccatcgaggaggggcgcaccctgcgggtgctgaagatggtggagccctggctccgcggcaaccagttctgcatcaagatcctgaacccctacatgccgagcgtcgtggagacgctggagcagatgcagcggaagcacggcgggatgctcgtgcgcaaccccctgtcccggaacagcacccacgagatgtactgggtctcctgcggcaccgggaacatcgtgagcgcggtgaacatgacctcccgcatgctgctcaaccggttcacgaccgcccaccgcaagcccacctacgagcgcgacgtcgacctgggcgccggcacccggcacgtggccgtggagcccgaggtcgccaacctggacatcatcgggcagcgcatcgagaacatcaagaacgagcacaagagcacgtggcactacgacgaggacaacccgtacaagacctgggcgtaccacggctcctacgaggtgaagcccagcgggtccgccagctccatggtgaacggcgtcgtgcggctcctgaccaagccctgggacgtgatccccatggtcacccagatcgccatgacggacaccaccccgttcgggcagcagcgcgtgttcaaggagaaggtcgacacccggacgccccgcgccaagcggggcaccacccagatcatggaggtgaccgccaagtggctgtggggcttcctcagccgcaacaagaagccccggatctgcacgcgcgaggagttcacccggaaggtgcgcagcaacgcggccatcggggccgtcttcgtggacgagaaccagtggaactccgccaaggaggcggtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaagatcccgggcggcaacatgtacgccgacgacaccgccgggtgggacacgcggatcaccgaggacgacctgcagaacgaggccaagatcaccgagatcatggagcccgagcacgccctcctggcgacctccatcttcaagctgacgtaccagaacaaggtcgtgcgcgtgcagcgccccgccaagaacggcaccgtcatggacgtgatcagccggcgcgaccagcgggggtccggccaggtgggcacctacgggctcaacaccttcacgaacatggaggtccagctgatccgccagatggagagcgagggcatcttcctgccctccgagctcgagaccccgaacctggccgagcgggtgctggactggctcgagaagcacggggccgagcgcctgaagcggatggccatcagcggcgacgactgcgtggtcaagcccatcgacgaccgcttcgcgaccgccctgaccgccctcaacgacatggggaaggtgcggaaggacatcctgcagtgggagccctccaagggctggaacgactggcagcaggtccccttctgcagccaccacttccaccagctgatcatgaaggacggccgcgagatcgtcgtgccgtgccggaaccaggacgagctcgtggggcgcgcccgggtctcccagggcgccgggtggagcctgcgcgagaccgcgtgcctgggcaagtcctacgcccagatgtggcagctcatgtacttccaccggcgcgacctgcggctggccgccaacgcgatctgcagcgccgtgcccgtggactgggtccccacgagccgcaccacctggtccatccacgcccaccaccagtggatgaccacggaggacatgctcagcgtgtggaaccgggtgtggatcgaggagaacccctggatggaggacaagacccacgtctccagctgggaggaggtgccgtacctggggaagcgcgaggaccagtggtgcggctccctgatcggcctcaccgcccgcgccacctgggcgacgaacatccaggtggccatcaaccaggtccggcgcctgatcgggaacgagaactacctggactacatgaccagcatgaagcggttcaagaacgagtccgaccccgagggcgccctctggtga

SEQ ID NO: 8122 - RNA, 9879 nt, synthetic construct
  misc_feature 1..9879: note = derived and/or modified CDS sequence (opt1) from DENV-1__KJ189347__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtgacctacgggacctgcagccagaccggcgagcaccggcgggacaagcgctccgtggccctggcgccccacgtgggcctggggctcgagacgcggaccgagacctggatgagcagcgagggcgcctggaagcagatccagcgcgtggagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctgttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggcccttcaagctggagaaggaggtcgcggagacgcagcacggcaccgtgctggtgcaggtcaagtacgagggcaccgacgccccctgcaagatcccgttcctcacccaggacgagaagggggtgacgcagaacggccgcctgatcaccgccaaccccatcgtgaccgacaaggagaagcccgtcaacatcgagaccgagcccccgttcggggagagctacatcgtggtgggcgccggcgagaaggcgctgaagctctcctggttcaagaaggggagctccatcggcaagatgttcgaggccacggcccgcggggcccgccggatggccatcctgggcgacaccgcgtgggacttcgggagcatcggcggcgtcttcacctccgtggggaagctggtgcaccaggtcttcggcaccgcctacggggtcctgttcagcggcgtgtcctggacgatgaagatcgggatcggcatcctgctgacctggctcggcctgaacagccgctccaccagcctgtccatgacctgcatcgccgtcgggatggtgacgctctacctgggcgtgatggtccaggccgacagcgggtgcgtgatcaactggaagggccgcgagctgaagtgcgggtccggcatcttcgtgaccaacgaggtccacacctggaccgagcagtacaagttccaggccgacagccccaagcggctctccgcggccatcggcaaggcctgggaggagggggtgtgcggcatccgcagcgccacccggctggagaacatcatgtggaagcagatcagcaacgagctgaaccacatcctcctggagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggccggacacccccgagtgccccgacaaccagcgggcctggaacatctgggaggtggaggactacggcttcgggatcttcacgaccaacatctggctcaagctgcgcgactcctacacccagatgtgcgaccaccggctgatgagcgcggccatcaaggactccaaggccgtccacgccgacatgggctactggatcgagagcgagaagaacgagacctggaagctcgcccgcgcgtccttcatcgaggtgaagacgtgcacctggcccaagagccacaccctgtggtccaacggcgtgctggagagcgagatgatcatcccgaagatctacgggggccccatctcccagcacaactaccggcccgggtacttcacccagacggccggcccgtggcacctcgggaagctggagctggacttcgacctctgcgagggcaccaccgtcgtggtggacgagcactgcggcaaccgcgggcccagcctgcggaccacgaccgtcaccggcaagatcatccacgagtggtgctgccgctcctgcaccctgccgcccctccggttccgcggggaggacggctgctggtacgggatggagatccggccggtgaaggagaaggaggagaacctggtgcgcagcatggtctccgccggcagcggcgaggtggactccttcagcctggggatcctctgcgtgagcatcatgatcgaggaggtcatgcggtcccgctggagccggaagatgctgatgacgggcaccctggccgtgttcctcctgctggtgatggggcagctcacctggaacgacctgatccgcctgtgcatcatggtcggcgccaacgcgtccgaccgcatggggatgggcaccacgtacctcgccctgatggccaccttcaagatgcggcccatgttcgccgtggggctcctcttccgccggctgaccagccgcgaggtgctgctcctgaccatcgggctgtccctcatggccagcgtcgagctgcccaactccctggaggagctcggcgacgggctggcgatgggcatcatgatgctgaagctcctgacggagttccagccccaccagctgtggaccaccctcctgagcctgaccttcatcaagacgaccctctccctggactacgcctggaagaccaccgccatggccctgagcatcgtgtccctcttcccgctgtgcctgagcacgacctcccagaagaccacctggctccccgtcctgctgggcagcttcgggtgcaagcccctcaccatgttcctgatcacggagaacaagatctggggccggaagtcctggcccctgaacgaggggatcatggcgatcggcatcgtgagcatcctcctgtccagcctgctcaagaacgacgtgccgctggccgggcccctgatcgccggcggcatgctcatcgcctgctacgtcatctccgggagcagcgccgacctgtccctggagaaggcggccgaggtgagctgggagcaggaggccgagcactccggcaccagccacaacatcctcgtggaggtccaggacgacgggaccatgaagatcaaggacgaggagcgcgacgacaccctgacgatcctgctcaaggccaccctgctggccgtgtccggcgtgtaccccatgagcatccccgcgaccctcttcgtctggtacttctggcagaagaagaagcagcggtccggggtgctgtgggacaccccgtccccgcccgaggtggagcgcgccgtcctggacgacggcatctaccggatcctgcagcgcggcctcctggggcggtcccaggtgggcgtgggggtcttccaggacggcgtgttccacacgatgtggcacgtgacccgcggggccgtcctgatgtaccagggcaagcggctcgagcccagctgggcctccgtgaagaaggacctgatcagctacggcgggggctggcgcttccaggggtcctggaacaccggcgaggaggtgcaggtcatcgccgtggagccggggaagaaccccaagaacgtgcagaccacgcccggcaccttcaagacccccgagggcgaggtcggggcgatcgccctggacttcaagccgggcaccagcgggtcccccatcgtgaaccgggagggcaagatcgtgggcctctacgggaacggcgtcgtgacgaccagcgggacctacgtgtccgccatcgcccaggccaaggcgagccaggagggccccctgccggagatcgaggacgaggtcttcaagaagcgcaacctgaccatcatggacctccaccccgggtccggcaagacgcggcgctacctgcccgccatcgtgcgggaggccatcaagcgcaagctgcggaccctcatcctggcccccacccgcgtggtcgcgagcgagatggccgaggccctgaagggcatgccgatccgctaccagaccacggccgtcaagagcgagcacaccgggcgggagatcgtggacctcatgtgccacgccaccttcaccatgcgcctgctgtcccccgtccgggtgcccaactacaacatgatcatcatggacgaggcgcacttcacggaccccgccagcatcgccgcccgcggctacatctccacccgggtggggatgggcgaggccgcggccatcttcatgaccgccaccccgcccgggagcgtcgaggccttcccccagtccaacgccgtgatccaggacgaggagcgcgacatccccgagcggagctggaactccggctacgactggatcacggacttcccgggcaagaccgtgtggttcgtccccagcatcaagtccgggaacgacatcgcgaactgcctccgcaagaacggcaagcgggtgatccagctgagccgcaagaccttcgacaccgagtaccagaagacgaagaacaacgactgggactacgtggtcaccaccgacatctccgagatgggggccaacttccgggccgaccgcgtgatcgacccccggcgctgcctgaagcccgtgatcctcaaggacggcccggagcgggtcatcctggccgggcccatgcccgtgaccgtggcgagcgccgcccagcgccggggccgcatcggccggaaccagaacaaggagggggaccagtacgtctacatgggccagcccctgaacaacgacgaggaccacgcccactggacggaggccaagatgctcctggacaacatcaacaccccggaggggatcatccccgcgctgttcgagcccgagcgcgagaagtccgccgccatcgacggcgagtaccgcctccgcggggaggcccgcaagaccttcgtggagctgatgcggcgcggcgacctgcccgtctggctcagctacaaggtggcctccgagggcttccagtacagcgaccggcgctggtgcttcgacggggagcggaacaaccaggtgctggaggagaacatggacgtcgagatctggaccaaggagggcgagcgcaagaagctgcggccgcgctggctcgacgcgcggacctactccgaccccctggccctgcgcgagttcaaggagttcgccgccgggcggcgcagcgtgtccggcgacctcatcctggagatcggcaagctgccccagcacctcacgctgcgggcccagaacgcgctggacaacctcgtgatgctgcacaacagcgagcagggcgggaaggcctaccgccacgccatggaggagctgcccgacaccatcgagaccctcatgctgctggccctcatcgcggtcctgaccgggggcgtgacgctgttcttcctcagcgggaagggcctgggcaagacctccatcgggctgctctgcgtgaccgccagctccgccctgctgtggatggccagcgtcgagccgcactggatcgccgcgtccatcatcctcgagttcttcctgatggtgctgctcatccccgagcccgaccggcagcgcaccccgcaggacaaccagctggcctacgtggtcatcggcctcctcttcatgatcctgacggtggccgccaacgagatggggctgctcgagaccaccaagaaggacctgggcatcgggcacgtggccgcggagaaccaccagcacgccaccatgctggacgtcgacctccggcccgccagcgcctggacgctgtacgccgtggcgaccaccgtgatcacccccatgatgcgccacacgatcgagaacaccaccgccaacatctccctgaccgccatcgccaaccaggccgcgatcctcatgggcctggacaagggctggcccatcagcaagatggacatcggggtcccgctgctcgccctgggctgctactcccaggtgaaccccctgacgctcaccgccgccgtgctgatgctggtcgcgcactacgccatcatcgggcccggcctccaggccaaggccacccgggaggcccagaagcgcaccgcggccgggatcatgaagaaccccacggtggacggcatcgtggccatcgacctggacccggtcgtgtacgacgccaagttcgagaagcagctgggccagatcatgctcctgatcctgtgcaccagccagatcctcctgatgcgcaccacctgggccctgtgcgagtccatcacgctcgcgaccgggcccctgaccaccctgtgggagggcagccccgggaagttctggaacacgaccatcgccgtgtccatggccaacatcttccggggcagctacctcgccggcgccgggctggcgttctccctgatgaagtccctcggcgggggccgccgggggaccggcgcccagggcgagaccctgggggagaagtggaagcgccagctgaaccagctctccaagagcgagttcaacacgtacaagcggtccggcatcatggaggtcgaccgcagcgaggccaaggaggggctgaagcggggcgagaccaccaagcacgccgtgagccgcgggaccgcgaagctgcggtggttcgtggagcgcaacctggtcaagcccgagggcaaggtgatcgacctcggctgcgggcggggcgggtggtcctactactgcgccggcctgaagaaggtgaccgaggtcaaggggtacacgaagggcggcccggggcacgaggagcccatccccatggccacctacggctggaacctggtgaagctccacagcgggaaggacgtgttcttcatgcccccggagaagtgcgacaccctgctgtgcgacatcggcgagtccagccccaaccccaccatcgaggaggggcgcacgctccgggtcctgaagatggtggagccctggctgcgcggcaaccagttctgcatcaagatcctcaacccgtacatgccctccgtggtcgagaccctggagcagatgcagcggaagcacggcgggatgctggtgcgcaaccccctcagccggaactccacccacgagatgtactgggtgagctgcggcaccgggaacatcgtctccgccgtgaacatgacgagccgcatgctgctgaaccggttcaccatggcccaccgcaagcccacctacgagcgcgacgtggacctcggcgcgggcacccggcacgtcgccgtggagccggaggtggccaacctggacatcatcgggcagcgcatcgagaacatcaagaacgagcacaagtccacgtggcactacgacgaggacaacccctacaagacctgggcctaccacggcagctacgaggtccggccctccgggagcgcctccagcatggtgaacggcgtggtccgcctgctcaccaagccctgggacgtgatcccgatggtcacccagatcgcgatgacggacaccacccccttcgggcagcagcgggtgttcaaggagaaggtggacacccgcacgccccgggccaagcgcggcaccacccagatcatggaggtcaccgccaagtggctgtggggcttcctgtcccggaacaagaagccgcgcatctgcacgcgggaggagttcacccgcaaggtgcggagcaacgccgccatcggggcggtgttcgtcgacgagaaccagtggaactccgccaaggaggccgtggaggacgagcgcttctgggacctcgtgcaccgggagcgcgagctgcacaagcagggccggtgcgcgacctgcgtctacaacatgatggggaagcgcgagaagaagctgggcgagttcgggaaggcgaagggcagccgggccatctggtacatgtggctcggcgcccgcttcctggagttcgaggccctggggttcatgaacgaggaccactggttcagccgggagaactccctcagcggcgtggagggggagggcctgcacaagctggggtacatcctccgcgacatctccaagatccccggcggcaacatgtacgccgacgacaccgcggggtgggacacgcgcatcaccgaggacgacctgcagaacgaggccaagatcaccgagatcatggagcccgagcacgccctgctcgccaccagcatcttcaagctgacgtaccagaacaaggtggtccgggtgcagcgccccgccaagaacggcaccgtgatggacgtcatctcccggcgcgaccagcgggggagcggccaggtgggcacctacgggctgaacaccttcacgaacatggaggtgcagctcatccgccagatggagtccgagggcatcttcctgccgagcgagctggagacccccaacctcgcggagcgggtcctggactggctggagaagcacggggccgagcgcctcaagcggatggccatctccggcgacgactgcgtggtgaagcccatcgacgaccgcttcgccaccgccctgaccgcgctgaacgacatggggaaggtccggaaggacatcccccagtgggagccgagcaagggctggaacgactggcagcaggtccccttctgctcccaccacttccaccagctcatcatgaaggacggccgcgagatcgtggtcccctgccggaaccaggacgagctggtggggcgcgcccgggtgagccagggcgccgggtggtccctgcgcgagaccgcctgcctcggcaagagctacgcccagatgtggcagctgatgtacttccaccggcgcgacctgcggctcgcggccaacgccatctgctccgccgtccccgtggactgggtgccgacgagccgcaccacctggtccatccacgcgcaccaccagtggatgaccacggaggacatgctgagcgtctggaaccgcgtgtggatcgaggagaacccctggatggaggacaagacccacgtgagctcctgggaggaggtcccctacctggggaagcgggaggaccagtggtgcggcagcctcatcggcctgaccgcccgcgccacctgggccacgaacatccaggtggccatcaaccaggtgcggcgcctgatcgggaacgagaactacctcgactacatgacctccatgaagcggttcaagaacgagagcgaccccgagggcgcgctgtggtga

SEQ ID NO: 8123 - RNA, 9879 nt, synthetic construct
  misc_feature 1..9879: note = derived and/or modified CDS sequence (opt1) from DENV-1__KJ189348__SS-prME
  source 1..9879: mol_type = other RNA
agcgtgaccatgctgctcatgctgctgcccaccgccctcgccttccacctgaccacccggggcggggagccgcacatgatcgtgagcaagcacgagcggggcaagagcctcctcttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccggctcatcaccgccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccacggcccgcggggcccggcgcatggccatcctcggcgacaccgcgtgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcttctccatgacctgcatcgccgtggggatggtgacgctgtacctgggcgtcatggtgcaggccgacagcgggtgcgtgatcaactggaagggccgggagctcaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcacggtcgtggtgggggacgccaacggcatcctcgcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacgaccagcgcgcctggaacatctgggaggtcgaggactacggcttcgggatcttcacgaccaacatctggctgaagctgcgggactcctacacccagatgtgcgaccaccgcctcatgagcgcggccatcaaggactccaaggccgtgcacgccgacatgggctactggatcgagagcgagaagaacgagacctggaagctggcccgggcgtccttcatcgaggtgaagacgtgcacctggcccaagagccacaccctgtggtccaacggcgtcctcgagagcgagatgatcatccccaagatctacgggggcccgatctcccagcacaactaccgccccgggtacttcacccagacggccggcccctggcacctggggaagctggagctcgacttcgacctgtgcgagggcaccaccgtggtggtcgacgagcactgcggcaaccgggggccgagcctgcgcaccacgaccgtgaccggcaagatcatccacgagtggtgctgccggtcctgcaccctgccgcccctgcgcttccgcggggaggacggctgctggtacgggatggagatccgccccgtgaaggagaaggaggagaacctggtccggagcatggtgtccgccggcagcggcgaggtggacagcttctccctcgggatcctgtgcgtcagcatcatgatcgaggaggtgatgcgctcccggtggagccgcaagatgctgatgacgggcaccctcgccgtgttcctgctgctcatcatggggcagctgacctggaacgacctgatccgcctctgcatcatggtcggcgccaacgcgtccgaccggatggggatgggcaccacgtacctggccctgatggccaccttcaagatgcgcccgatgttcgccgtggggatcctcttccggcgcctgaccagccgggaggtgctgctcctgaccatcgggctgtccctcgtcgccagcgtggagctgcccaactccctggaggagctcggcgacgggctggcgatgggcatcatgatgctgaagctcctgacggagttccagccccaccagctgtggaccaccctcctgagcctgaccttcatcaagacgaccctctccctggactacgcctggaagaccaccgccatggccctgagcatcgtctccctcttccccctgtgcctgagcacgacctcccagaagaccacctggctcccggtgctgctgggcagcttcgggtgcaagcccctcaccatgttcctgatcacggagaacaagatctggggccgcaagtcctggcccatcaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgcggatcaaggacgaggagaaggacgacaccctcacgatcctgctgaaggccaccctcctggccgtgtccggcgtctaccccatgagcatccccgcgaccctgttcgtgtggtacttctggcagaagaagaagcagcgctccggggtgctctgggacacccccagcccgcccgaggtcgagcgggccgtgctggacgacggcatctaccgcatcctgcagcggggcctcctggggcgctcccaggtgggcgtcggggtgttccaggacggcgtgttccacacgatgtggcacgtcacccgcggggccgtgctgatgtaccagggcaagcgcctggagcccagctgggcctccgtgaagaaggacctcatcagctacggcgggggctggcggttccaggggtcctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcaccagcgggtccccgatcgtgaaccgcgagggcaagatcgtcggcctgtacgggaacggcgtggtgacgaccagcgggacctacgtctccgccatcgcccaggccaaggcgagccaggagggccccctccccgagatcgaggacgaggtgttcaagaagcggaacctgaccatcatggacctgcacccggggagcggcaagacgcgccggtacctccccgccatcgtgcgcgaggccatcaagcggaagctgcgcaccctgatcctcgcccccacccgcgtcgtggcgtccgagatggccgaggccctgaagggcatgcccatccggtaccagaccacggccgtcaagagcgagcacaccgggcgcgagatcgtcgacctgatgtgccacgccaccttcaccatgcggctcctgtccccggtgcgcgtgcccaactacaacatgatcatcatggacgaggcgcacttcacggaccccgccagcatcgccgcccggggctacatctccacccgcgtcgggatgggcgaggccgcggccatcttcatgaccgccacgccgcccgggagcgtggaggccttcccccagtccaacgccgtgatccaggacgaggagcgggacatccccgagcgcagctggaactccggctacgactggatcacggacttccccggcaagaccgtctggttcgtgcccagcatcaagtccgggaacgacatcgcgaactgcctgcggaagaacggcaagcgcgtgatccagctcagccggaagaccttcgacaccgagtaccagaagacgaagaacaacgactgggactacgtcgtgaccaccgacatctccgagatgggggccaacttccgcgccgaccgggtgatcgacccccgccggtgcctgaagcccgtcatcctgaaggacggccccgagcgcgtgatcctcgccgggccgatgcccgtgaccgtcgcgagcgccgcccagcggcgcggccggatcggccgcaaccagaacaaggagggggaccagtacgtgtacatgggccagcccctgaacaacgacgaggaccacgcccactggacggaggccaagatgctgctcgacaacatcaacacccccgaggggatcatcccggcgctgttcgagcccgagcgcgagaagtccgccgccatcgacggcgagtaccggctgcgcggggaggcccggaagaccttcgtcgagctcatgcgccggggcgacctgcccgtgtggctgagctacaaggtggcctccgagggcttccagtacagcgaccgccggtggtgcttcgacggggagcgcaacaaccaggtcctcgaggagaacatggacgtggagatctggaccaaggagggcgagcggaagaagctgcgcccccggtggctggacgcgcgcacctactccgacccgctcgccctgcgggagttcaaggagttcgccgccgggcgccggagcgtgagcggcgacctgatcctcgagatcggcaagctgccccagcacctgacgctccgcgcccagaacgcgctggacaacctggtcatgctccacaactccgagcagggcgggaaggcctaccggcacgccatggaggagctgcccgacaccatcgagaccctgatgctcctggccctgatcgcggtgctcaccgggggcgtgacgctgttcttcctgagcgggaagggcctcggcaagacctccatcgggctgctgtgcgtcaccgccagctccgccctcctgtggatggccagcgtggagccccactggatcgccgcgtccatcatcctggagttcttcctcatggtgctgctgatcccggagcccgaccgccagcggacgccccaggacaaccagctcgcctacgtcgtgatcggcctgctgttcatgatcctcacggtggccgccaacgagatggggctgctggagaccaccaagcgcgacctcggcatcgggcacgtcgccgcggagaaccaccagcacgccaccatgctggacgtggacctgcggccggccagcgcctggacgctctacgccgtggcgaccaccgtcatcacccccatgatgcgccacacgatcgagaacaccaccgccaacatctccctgaccgccatcgccaaccaggccgcgatcctgatgggcctcgacaagggctggcccatcagcaagatggacatcggggtgcccctgctggccctcggctgctactcccaggtgaacccgctgacgctgaccgccgccgtcctcatgctggtggcgcactacgccatcatcgggcccggcctgcaggccaaggccacccgcgaggcccagaagcggaccgcggccgggatcatgaagaaccccacggtggacggcatcgtcgccatcgacctcgaccccgtggtgtacgacgccaagttcgagaagcagctgggccagatcatgctgctcatcctgtgcaccagccagatcctgctcatgcgcaccacctgggccctgtgcgagtccatcacgctggcgaccgggccgctcaccaccctgtgggagggcagccccgggaagttctggaacacgaccatcgccgtctccatggccaacatcttccggggcagctacctggccggcgccgggctcgcgttctccctgatgaagtccctgggcgggggccgccgggggaccggcgcccagggcgagaccctcggggagaagtggaagcgccagctgaaccagctgtccaagcccgagttcaacacgtacaagcggagcggcatcatggaggtggaccgcagcgaggccaaggaggggctcaagcggggcgagaccaccaagcacgccgtgtcccgcgggaccgcgaagctgcggtggttcgtcgagcgcaacctggtgaagcccgagggcaaggtgatcgacctcggctgcgggcggggcgggtggagctactactgcgccggcctgaagaaggtcaccgaggtgaaggggtacacgaagggcggcccggggcacgaggagcccatccccatggccacctacggctggaacctggtgaagctgcactccgggaaggacgtcttcttcatgcccccggagaagtgcgacaccctcctgtgcgacatcggcgagagctcccccaaccccaccatcgaggaggggcgcacgctgcgggtgctcaagatggtggagccctggctgcgcggcaaccagttctgcatcaagatcctgaacccgtacatgcccagcgtcgtggagaccctcgagcagatgcagcggaagcacggcgggatgctggtgcgcaaccccctgtcccggaacagcacccacgagatgtactgggtctcctgcggcaccgggaacatcgtgagcgccgtgaacatgacgtcccgcatgctcctgaaccgcttcaccatggcccaccggaagcccacctacgagcgcgacgtcgacctgggcgcgggcacccggcacgtggccgtggagccggaggtcgccaacctcgacatcatcgggcagcgcatcgagaacatcaagaacgagcacaagagcacgtggcactacgacgaggacaacccctacaagacctgggcctaccacggctcctacgaggtgaagcccagcgggtccgccagctccatggtgaacggcgtcgtgcggctgctgaccaagccctgggacgtcatcccgatggtgacccagatcgcgatgacggacaccacccccttcgggcagcagcgcgtgttcaaggagaaggtcgacacccggacgccccgcgccaagcggggcaccacccagatcatggaggtgaccgccaagtggctctggggcttcctgagccgcaacaagaagccgcggatctgcacgcgcgaggagttcacccggaaggtgcgctccaacgccgccatcggggcggtcttcgtggacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggcgaagggcagccgggccatctggtacatgtggctgggcgcccgcttcctcgagttcgaggccctggggttcatgaacgaggaccactggttctcccgggagaacagcctgtccggcgtggagggggagggcctccacaagctggggtacatcctgcgcgacatcagcaagatccccggcggcaacatgtacgccgacgacaccgcggggtgggacacgcgcatcaccgaggacgacctccagaacgaggccaagatcaccgacatcatggagcccgagcacgccctgctggccacctccatcttcaagctcacgtaccagaacaaggtcgtgcgggtgcagcgccccgccaagaacggcaccgtcatggacgtgatcagccggcgcgaccagcgggggtccggccaggtgggcacctacgggctgaacaccttcacgaacatggaggtccagctgatccgccagatggagagcgagggcatcttcctcccgtccgagctggagacccccaacctggcggagcgggtgctcaactggctggagaagcacggggccgagcgcctgaagcggatggccatcagcggcgacgactgcgtggtcaagcccatcgacgaccgcttcgccaccgccctcaccgcgctgaacgacatggggaaggtgcggaaggacatcccccagtgggagccgtccaagggctggaacgactggcagcaggtccccttctgcagccaccacttccaccagctgatcatgaaggacggccgcgagatcgtcgtgccctgccggaaccaggacgagctcgtggggcgcgcccgggtctcccagggcgccgggtggagcctgcgcgagaccgcctgcctgggcaagtcctacgcccagatgtggcagctcatgtacttccaccggcgcgacctgcggctggcggccaacgccatctgcagcgccgtgcccgtggactgggtcccgacgtcccgcaccacctggagcatccacgcgcaccaccagtggatgaccacggaggacatgctcagcgtgtggaaccgcgtgtggatcgaggagaacccctggatggaggacaagacccacgtctccagctgggaggaggtgccctacctggggaagcgggaggaccagtggtgcggctccctgatcggcctcaccgcccgcgccacctgggccacgaacatccaggtggccatcaaccaggtccggcgcctgatcgggaacgagaactacctggactacatgaccagcatgaagcggttcaagaacgagtccgaccccgagggcgcgctctggtga

SEQ ID NO: 8124 - RNA, 9879 nt, synthetic construct
  misc_feature 1..9879: note = derived and/or modified CDS sequence (opt1) from DENV-1__KJ189368__SS-prME
  source 1..9879: mol_type = other RNA
agcgtgaccatgctgctcatgctgctgcccaccgccctcgccttccacctgaccacccggggcggggagccccacatgatcgtgtccaagcaggagcggggcaagagcctcctgttcaagacctccgccggggtgaacatgtgcaccctgatcgccatggacctgggcgagctctgcgaggacaccatgacctacaagtgcccccagatcaccgaggccgagcccgacgacgtggactgctggtgcaacgccaccgacacgtgggtcacctacgggacctgcagccagaacggcgagcaccgccgggacaagcgctccgtggccctggcgccccacgtgggcctggggctcgagacccggacggagacctggatgagctccgagggcgcctggaagcagatccagcgcgtcgagacctgggccctgcggcaccccgggttcaccgtgatcgccctgttcctcgcgcacgccatcggcacgagcatcacccagaaggggatcatcttcatcctgctgatgctcgtgaccccctccatggccatgcgctgcgtcggcatcggcaaccgggacttcgtggaggggctgagcggcgccacctgggtggacgtcgtgctggagcacgggtcctgcgtgacgaccatggccaagaacaagcccaccctcgacatcgagctgctgaagaccgaggtcacgaaccccgcgatcctccgcaagctgtgcatcgaggccaagatcagcaacaccaccaccgactcccggtgcccgacgcagggcgaggccaccctggtggaggagcaggacgccaacttcgtgtgccgccggaccttcgtcgaccgcggctgggggaacggctgcggcctcttcggcaaggggagcctgctgacctgcgccaagttcaagtgcgtgacgaagctcgagggcaagatcgtgcagtacgagaacctgaagtactccgtcatcgtgaccgtgcacaccggcgaccagcaccaggtcgggaacgagaccacggagcacggcaccatcgcgaccatcacgccccaggcccccaccagcgagatccagctgacggactacggggccctcaccctggactgcagcccccggaccggcctggacttcaacgagatggtgctcctgaccatgaaggagaagtcctggctggtccacaagcagtggttcctcgacctgccgctgccctggacgtccggggccagcaccagccaggagacctggaaccgccaggacctcctggtgaccttcaagacggcccacgcgaagaagcaggaggtggtcgtgctgggctcccaggagggcgccatgcacaccgccctcaccggggccaccgagatccagacgagcggcaccaccaccatcttcgccgggcacctgaagtgccggctgaagatggacaagctcacgctgaagggcacctcctacgtgatgtgcaccgggcccttcaagctggagaaggaggtcgcggagacccagcacggcacggtgctggtgcaggtcaagtacgagggcaccgacgccccctgcaagatcccgttcagcacccaggacgagaagggggtgacccagaacggccgcctcatcacggccaaccccatcgtgaccgacaaggagaagcccgtcaacatcgagaccgagcccccgttcggggagtcctacatcgtggtgggcgccggcgagaaggcgctgaagctgagctggttcaagaaggggtccagcatcggcaagatgttcgaggccaccgcccgcggggcccgccggatggccatcctcggcgacacggcgtgggacttcgggtccatcggcggcgtcttcaccagcgtggggaagctggtgcaccaggtcttcggcaccgcctacggggtgctgttctccggcgtgagctggaccatgaagatcgggatcggcatcctcctgacgtggctgggcctcaactcccgcagcacctccctgagcatgacctgcatcgccgtcgggatggtgaccctgtacctcggcgtgatggtccaggccgactccgggtgcgtgatcaactggaagggccgcgagctgaagtgcgggagcggcatcttcgtgacgaacgaggtccacacctggaccgagcagtacaagttccaggccgactcccccaagcggctgagcgcggccatcggcaaggcctgggaggagggggtgtgcggcatccgcagcgccacccggctcgagaacatcatgtggaagcagatctccaacgagctgaaccacatcctgctcgagaacgacatgaagttcaccgtggtcgtgggggacgccaacggcatcctggcgcaggggaagaagatgatccgcccccagcccatggagcacaagtacagctggaagtcctggggcaaggccaagatcatcggcgccgacatccagaacacgaccttcatcatcgacgggccggacacccccgagtgccccgacaaccagcgggcctggaacatctgggaggtggaggactacggcttcgggatcttcaccacgaacatctggctgaagctccgcgacagctacacccagatgtgcgaccaccggctgatgtccgcggccatcaaggacagcaaggccgtccacgccgacatgggctactggatcgagtccgagaagaacgagacctggaagctggcccgcgcgagcttcatcgaggtgaagacctgcacgtggcccaagtcccacaccctctggagcaacggcgtgctggagtccgagatgatcatcccgaagatctacgggggccccatcagccagcacaactaccggcccgggtacttcacccagaccgccggcccgtggcacctggggaagctcgagctggacttcgacctgtgcgagggcacgaccgtcgtggtggacgagcactgcggcaaccgcgggccctccctccggaccaccacggtcaccggcaagatcatccacgagtggtgctgccgcagctgcaccctgccgcccctgcggttccgcggggaggacggctgctggtacgggatggagatccggccggtgaaggagaaggaggagaacctcgtgcgctccatggtcagcgccggctccggcgaggtggacagcttcagcctggggatcctgtgcgtgtccatcatgatcgaggaggtcatgcggagccgctggtcccggaagatgctcatgaccggcacgctggccgtgttcctgctcctggtgatggggcagctgacctggaacgacctcatccgcctgtgcatcatggtcggcgccaacgcgagcgaccgcatggggatgggcaccacctacctggccctcatggccacgttcaagatgcggcccatgttcgccgtggggctgctgttccgccggctcacctcccgcgaggtgctgctgctcaccatcgggctgagcctggtcgcctccgtggagctccccaacagcctggaggagctgggcgacgggctcgcgatgggcatcatgatgctgaagctgctcaccgagttccagccccaccagctgtggacgaccctgctctccctgaccttcatcaagaccacgctgagcctcgactacgcctggaagaccaccgccatggccctgtccatcgtcagcctgttcccgctctgcctgtccaccacgagccagaagaccacctggctgcccgtgctcctgggctccttcgggtgcaagcccctgaccatgttcctcatcaccgagaacaagatctggggccgcaagagctggcccctgaacgaggggatcatggcgatcggcatcgtgtccatcctgctcagctccctgctgaagaacgacgtcccgctcgccgggcccctgatcgccggcggcatgctgatcgcctgctacgtgatcagcgggagctccgccgacctcagcctggagaaggcggccgaggtgtcctgggagcaggaggccgagcacagcggcacgtcccacaacatcctggtcgaggtgcaggacgacgggaccatgaagatcaaggacgaggagcgggacgacaccctcaccatcctgctgaaggccacgctcctggccgtgagcggcgtctaccccatgtccatccccgcgaccctgttcgtgtggtacttctggcagaagaagaagcagcggagcggggtgctctgggacaccccgagcccgcccgaggtcgagcgcgccgtgctggacgacggcatctaccggatcctgcagcgcggcctgctcgggcggagccaggtgggcgtcggggtgttccaggacggcgtgttccacaccatgtggcacgtcacgcgcggggccgtgctgatgtaccagggcaagcggctggagccctcctgggccagcgtgaagaaggacctcatctcctacggcgggggctggcgcttccaggggagctggaacaccggcgaggaggtccaggtgatcgccgtggagccggggaagaaccccaagaacgtccagaccacccccggcacgttcaagacccccgagggcgaggtgggggcgatcgccctggacttcaagccgggcacctccgggagccccatcgtgaaccgggagggcaagatcgtcggcctgtacgggaacggcgtggtgaccacgtccgggacctacgtcagcgccatcgcccaggccaaggcgtcccaggagggccccctcccggagatcgaggacgaggtgttcaagaagcgcaacctgaccatcatggacctgcaccccgggagcggcaagacccggcgctacctccccgccatcgtgcgggaggccatcaagcgcaagctgcggacgctgatcctcgcccccacccgcgtcgtggcgagcgagatggccgaggccctgaagggcatgccgatccgctaccagaccaccgccgtgaagtccgagcacacggggcgggagatcgtcgacctgatgtgccacgccaccttcaccatgcgcctcctgagccccgtgcgggtgcccaactacaacatgatcatcatggacgaggcgcacttcaccgaccccgcctccatcgccgcccgcggctacatcagcacgcgggtcgggatgggcgaggccgcggccatcttcatgaccgccaccccgcccgggtccgtggaggccttcccccagagcaacgccgtgatccaggacgaggagcgcgacatccccgagcggtcctggaacagcggctacgactggatcaccgacttcccgggcaagacggtctggttcgtgccctccatcaagagcgggaacgacatcgcgaactgcctgcgcaagaacggcaagcgggtgatccagctctcccgcaagaccttcgacaccgagtaccagaagaccaagaacaacgactgggactacgtcgtgacgaccgacatcagcgagatgggggccaacttccgggccgaccgcgtgatcgacccccggcgctgcctgaagcccgtcatcctgaaggacggcccggagcgggtgatcctcgccgggcccatgcccgtgaccgtcgcgtccgccgcccagcgccggggccgcatcggccggaaccagaacaaggagggggaccagtacgtgtacatgggccagcccctgaacaacgacgaggaccacgcccactggaccgaggccaagatgctgctcgacaacatcaacacgccggaggggatcatccccgcgctgttcgagcccgagcgcgagaagtccgccgccatcgacggcgagtaccgcctgcgcggggaggcccgcaagaccttcgtcgagctcatgcggcgcggcgacctgcccgtgtggctgtcctacaaggtggccagcgagggcttccagtactccgaccggcgctggtgcttcgacggggagcggaacaaccaggtcctcgaggagaacatggacgtggagatctggaccaaggagggcgagcgcaagaagctgcggccgcgctggctggacgcgcggacctacagcgaccccctcgccctgcgcgagttcaaggagttcgccgccgggcggcgctccatcagcggcgacctgatcctcgagatcggcaagctgccccagcacctgaccctccgggcccagaacgcgctggacaacctggtgatgctccacaacagcgagcagggcgggaaggcctaccgccacgccatggaggagctgcccgacacgatcgagaccctgatgctcctggccctgatcgcggtcctcaccgggggcgtgaccctgttcttcctgtccgggaagggcctcggcaagacgagcatcgggctgctgtgcgtgaccgcctccagcgccctcctgtggatggcctccgtcgagccgcactggatcgccgcgagcatcatcctggagttcttcctcatggtgctgctgatccccgagcccgaccggcagcgcaccccgcaggacaaccagctcgcctacgtggtcatcggcctgctgttcatgatcctcaccgtggccgccaacgagatggggctgctggagacgaccaagaaggacctcggcatcgggcacgtggccgcggagaaccaccagcacgccaccatgctggacgtcgacctgcggcccgcctccgcctggaccctctacgccgtggcgacgaccgtgatcacccccatgatgcgccacaccatcgagaacacgaccgccaacatcagcctgaccgccatcgccaaccaggccgcgatcctgatgggcctcgacaagggctggcccatctccaagatggacatcggggtcccgctgctggccctcggctgctacagccaggtgaaccccctgaccctgacggccgccgtgctcatgctggtcgcgcactacgccatcatcgggcccggcctgcaggccaaggccacccgggaggcccagaagcgcaccgcggccgggatcatgaagaaccccaccgtggacggcatcgtggccatcgacctcgacccggtcgtgtacgacgccaagttcgagaagcagctgggccagatcatgctgctcatcctgtgcacgtcccagatcctgctcatgcgcaccacctgggccctgtgcgagagcatcaccctggcgacggggcccctcaccaccctgtgggagggctcccccgggaagttctggaacaccacgatcgccgtgagcatggccaacatcttccggggctcctacctggccggcgccgggctcgcgttcagcctgatgaagtccctgggcgggggccgccgggggaccggcgcccagggcgagaccctcggggagaagtggaagcgccagctgaaccagctgagcaagtccgagttcaacacctacaagcggagcggcatcatggaggtcgaccgcagcgaggccaaggaggggctcaagcggggcgagacgaccaagcacgccgtgtcccgcgggaccgcgaagctgcggtggttcgtggagcgcaacctggtcaagcccgagggcaaggtgatcgacctgggctgcgggcggggcgggtggagctactactgcgccggcctcaagaaggtgaccgaggtcaaggggtacaccaagggcggcccggggcacgaggagcccatccccatggccacgtacggctggaacctggtgaagctgcactccgggaaggacgtgttcttcatgcccccggagaagtgcgacaccctcctgtgcgacatcggcgagagctcccccaaccccaccatcgaggaggggcgcaccctgcgggtcctcaagatggtggagccctggctgcgcggcaaccagttctgcatcaagatcctgaacccgtacatgcccagcgtggtcgagacgctcgagcagatgcagcggaagcacggcgggatgctggtgcgcaaccccctgtcccggaacagcacccacgagatgtactgggtgtcctgcggcaccgggaacatcgtcagcgccgtgaacatgacctcccgcatgctcctgaaccggttcacgatggcccaccgcaagcccacctacgagcgcgacgtggacctgggcgcgggcacccggcacgtcgccgtggagccggaggtggccaacctcgacatcatcgggcagcgcatcgagaacatcaagaacgagcacaagagcacctggcactacgacgaggacaacccctacaagacgtgggcctaccacggctcctacgaggtcaagcccagcgggtccgccagctccatggtgaacggcgtggtccggctgctgaccaagccctgggacgtgatcccgatggtcacccagatcgcgatgaccgacacgacccccttcgggcagcagcgcgtgttcaaggagaaggtggacacccggacgccccgggccaagcggggcacgacccagatcatggaggtcaccgccaagtggctctggggcttcctgagccgcaacaagaagccgcggatctgcacccgcgaggagttcacgcggaaggtgcgctccaacgccgccatcggggcggtgttcgtcgacgagaaccagtggaacagcgccaaggaggccgtggaggacgagcggttctgggacctggtgcaccgcgagcgggagctccacaagcagggcaagtgcgcgacctgcgtctacaacatgatggggaagcgcgagaagaagctgggcgagttcgggaaggcgaagggcagccgggccatctggtacatgtggctgggcgcccgcttcctcgagttcgaggccctggggttcatgaacgaggaccactggttctcccgggagaacagcctgtccggcgtggagggggagggcctccacaagctggggtacatcctgcgcgacatcagcaagatccccggcggcaacatgtacgccgacgacaccgcggggtgggacacccggatcacggaggacgacctccagaacgaggccaagatcaccgagttcatggagcccgagcacgccctgctggccacctccatcttcaagctcacctaccagaacaaggtggtccgcgtgcagcgccccgccaagaacggcacggtgatggacgtcatcagccggcgcgaccagcgggggtccggccaggtgggcacctacgggctgaacaccttcaccaacatggaggtgcagctgatccgccagatggagagcgagggcatcttcctcccgtccgagctggagacgcccaacctggcggagcgggtcttcgactggctcgagaagcacggggccgagcgcctgaagcggatggccatcagcggcgacgactgcgtggtgaagcccatcgacgaccgcttcgccaccgccctgaccgcgctcaacgacatggggaaggtccggaaggacatcccccagtgggagccgtccaagggctggaacgactggcagcaggtccccttctgcagccaccacttccaccagctgatcatgaaggacggccgcgagatcgtggtcccctgccggaaccaggacgagctggtggggcgcgcccgggtgtcccagggcgccgggtggagcctccgcgagaccgcctgcctgggcaagtcctacgcccagatgtggcagctgatgtacttccaccggcgcgacctccggctggcggccaacgccatctgcagcgccgtccccgtggactgggtgccgacctcccgcacgacctggagcatccacgcgcaccaccagtggatgaccaccgaggacatgctgagcgtctggaaccgggtgtggatcgaggagaacccctggatggaggacaagacgcacgtgtccagctgggaggaggtcccctacctcgggaagcgcgaggaccagtggtgcggctccctgatcggcctgaccgcccgcgccacctgggccaccaacatccaggtggccatcaaccaggtgcggcgcctcatcgggaacgagaactacctggactacatgacgagcatgaagcggttcaagaacgagtccgaccccgagggcgcgctgtggtga

SEQ ID NO: 8125 - RNA, 9879 nt, synthetic construct
  misc_feature 1..9879: note = derived and/or modified CDS sequence (opt1) from DENV-1__KJ189369__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgtgagcatcatgatcgaggaggtcatgcggtcccgctggagccggaagatgctcatgacgggcaccctggccgtgttcctgctcctggtgatggggcagctgacctggaacgacctcatccgcctgtgcatcatggtcggcgccaacgcgtccgaccgcatggggatgggcaccacgtacctggccctcatggccaccttcaagatgcggccgatgttcgccgtggggctgctgttccgccggctcaccagccgcgaggtgctgctgctcaccatcgggctgtccctggtcgccagcgtggagctccccaactccctggaggagctgggcgacgggctcgcgatgggcatcatgatgctgaagctgctcacggagttccagccccaccagctgtggaccaccctgctcagcctgaccttcatcaagacgaccctgtccctcgactacgcctggaagaccaccgccatggccctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggccgtgtccggcgtctaccccatgagcatccccgcgaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcaccagcgggtccccgatcgtgaaccgggagggcaagatcgtcggcctgtacgggaacggcgtggtgacgaccagcgggacctacgtctccgccatcgcccaggccaaggcgagccaggagggccccctccccgagatcgaggacgaggtgttcaagaagcgcaacctgaccatcatggacctgcacccggggagcggcaagacgcggcgctacctccccgccatcgtgcgggaggccatcaagcgcaagctgcggaccctgatcctcgcccccacccgcgtcgtggcgtccgagatggccgaggccctgaagggcatgcccatccgctaccagaccacggccgtcaagagcgagcacaccgggcgggagatcgtcgacctgatgtgccacgccaccttcaccatgcgcctcctgtccccggtgcgggtgcccaactacaacatgatcatcatggacgaggcgcacttcacggaccccgccagcatcgccgcccgcggctacatctccacccgggtcgggatgggcgaggccgcggccatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgcgaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgccgggccgatgcccgtgaccgtcgcgagcgccgcccagcgccggggccgcatcggccggaaccagaacaaggagggggaccagtacgtgtacatgggccagcccctgaacaacgacgaggaccacgcccactggacggaggccaagatgctgctcgacaacatcaacacccccgaggggatcatcccggcgctgttcgagcccgagcgcgagaagaacgccgccatcgacggcgagtaccgcctgcgcggggaggcccgcaagaccttcgtcgagctcatgcggcgcggcgacctgcccgtgtggctgtcctacaaggtggccagcgagggcttccagtactccgaccggcgctggtgcttcgacggggagcggaacaaccaggtcctcgaggagaacatggacgtggagatctggaccaaggagggcgagcgcaagaagctgcggccccgctggctggacgcgcggacctacagcgacccgctcgccctgcgcgagttcaaggagttcgccgccgggcggcgctccgtgagcggcgacctgatcctcgagatcggcaagctgccccagcacctgacgctccgggcccagaacgcgctggacaacctggtcatgctccacaacagcgagcagggcgggaaggcctaccgccacgccatggaggagctgcccgacaccatcgagaccctgatgctcctggccctgatcgcggtgctcaccgggggcgtgacgctgttcttcctgtccgggaagggcctcggcaagaccagcatcgggctgctgtgcgtcaccgcctccagcgccctcctgtggatggcctccgtggagccccactggatcgccgcgagcatcatcctggagttcttcctcatggtgctgctgatcccggagcccgaccggcagcgcacgccccaggacaaccagctcgcctacgtcgtgatcggcctgctgttcatgatcctcacggtggccgccaacgagatggggctgctggagaccaccaagaaggacctcggcatcgggcacgtcgccgcggagaaccaccagcacgccaccatgctggacgtggacctgcggccggcctccgcctggacgctctacgccgtggcgaccaccgtcatcacccccatgatgcgccacacgatcgagaacaccaccgccaacatcagcctgaccgccatcgccaaccaggccgcgatcctgatgggcctcgacaagggctggcccatctccaagatggacatcggggtgcccctgctggccctcggctgctacagccaggtgaacccgctgacgctgaccgccgccgtcctcatgctggtggcgcactacgccatcatcgggcccggcctgcaggccaaggccacccgggaggcccagaagcgcaccgcggccgggatcatgaagaaccccacggtggacggcatcgtcgccatcgacctcgaccccgtggtgtacgacgccaagttcgagaagcagctgggccagatcatgctgctcatcctgtgcacctcccagatcctgctcatgcgcaccacctgggccctgtgcgagagcatcacgctggcgaccgggccgctcaccaccctgtgggagggctcccccgggaagttctggaacacgaccatcgccgtcagcatggccaacatcttccggggctcctacctggccggcgccgggctcgcgttcagcctgatgaagtccctgggcgggggccgccgggggaccggcgcccagggcgagaccctcggggagaagtggaagcgccagctgaaccagctgagcaagtccgagttcaacacgtacaagcggagcggcatcatggaggtggaccgcagcgaggccaaggaggggctcaagcggggcgagaccaccaagcacgccgtgtcccgcgggaccgcgaagctgcggtggttcgtcgagcgcaacctggtgaagcccgagggcaaggtgatcgacctgggctgcgggcggggcgggtggagctactactgcgccggcctcaagaaggtcaccgaggtgaaggggtacacgaagggcggccccgggcacgaggagccgatccccatggccacctacggctggaacctggtgaagctgcactccgggaaggacgtcttcttcatgccgcccgagaagtgcgacaccctcctgtgcgacatcggcgagagctccccgaaccccaccatcgaggaggggcgcacgctgcgggtgctcaagatggtggagccctggctgcgcggcaaccagttctgcatcaagatcctgaacccctacatgccgagcgtcgtggagaccctcgagcagatgcagcggaagcacggcgggatgctggtgcgcaaccccctgtcccggaacagcacccacgagatgtactgggtctcctgcggcaccgggaacatcgtgagcgccgtgaacatgacgtcccgcatgctcctgaaccggttcaccatggcccaccgcaagcccacctacgagcgcgacgtcgacctgggcgcgggcacccggcacgtggccgtggagcccgaggtcgccaacctcgacatcatcgggcagcgcatcgagaacatcaagaacgagcacaagagcacgtggcactacgacgaggacaacccgtacaagacctgggcctaccacggctcctacgaggtgaagcccagcgggtccgccagctccatggtgaacggcgtcgtgcggctgctgaccaagccctgggacgtcatccccatggtgacccagatcgcgatgacggacaccaccccgttcgggcagcagcgcgtgttcaaggagaaggtcgacacccggacgccccgcgccaagcggggcaccacccagatcatggaggtgaccgccaagtggctctggggcttcctgagccgcaacaagaagccccggatctgcacgcgcgaggagttcacccggaaggtgcgctccaacgccgccatcggggcggtcttcgtggacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggcgaagggcagccgggccatctggtacatgtggctgggcgcccgcttcctcgagttcgaggccctggggttcatgaacgaggaccactggttctcccgggagaacagcctgtccggcgtggagggggagggcctccacaagctggggtacatcctgcgcgacatcagcaagatcccgggcggcaacatgtacgccgacgacaccgcggggtgggacacgcggatcaccgaggacgacctccagaacgaggccaagatcaccgagatcatggagcccgagcacgccctgctggccacctccatcttcaagctcacgtaccagaacaaggtcgtgcgcgtgcagcgccccgccaagaacggcaccgtcatggacgtgatcagccggcgcgaccagcgggggtccggccaggtgggcacctacgggctgaacaccttcacgaacatggaggtccagctgatccgccagatggagagcgagggcatcttcctcccctccgagctggagaccccgaacctggcggagcgggtgctcgactggctggagaagcacggggccgagcgcctgaagcggatggccatcagcggcgacgactgcgtggtcaagcccatcgacgaccgcttcgccaccgccctcaccgcgctgaacgacatggggaaggtgcggaaggacatcccccagtgggagccctccaagggctggaacgactggcagcaggtcccgttctgcagccaccacttccaccagctgatcatgaaggacggccgcgagatcgtcgtgccctgccggaaccaggacgagctcgtggggcgcgcccgggtctcccagggcgccgggtggagcctgcgcgagaccgcctgcctgggcaagtcctacgcccagatgtggcagctcatgtacttccaccggcgcgacctgcggctggcggccaacgccatctgcagcgccgtgcccgtggactgggtccccacgtcccgcaccacctggagcatccacgcgcaccaccagtggatgaccacggaggacatgctcagcgtgtggaaccgggtgtggatcgaggagaacccgtggatggaggacaagacccacgtctccagctgggaggaggtgccctacctggggaagcgcgaggaccagtggtgcggctccctgatcggcctcaccgcccgcgccacctgggccacgaacatccaggtggccatcaaccaggtccggcgcctgatcgggaacgagaactacctggactacatgaccagcatgaagcggttcaagaacgagtccgaccccgagggcgcgctctggtga

SEQ ID NO: 8126 - RNA, 9879 nt, synthetic construct
  misc_feature 1..9879: note = derived and/or modified CDS sequence (opt1) from DENV-1__EU482615__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgcggtcagccgcgggaccgccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacacgaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccaccatcgaggaggggcgcacgctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacccacgagatgtactgggtgagctgcggcaccgggaacatcgtgtccgccgtcaacatgacgagccgcatgctcctgaaccggttcaccatggcgcaccgcaagcccacctacgagcgcgacgtggacctgggcgccggcacccggcacgtggccgtcgagcccgaggtggccaacctcgacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtcaacggcgtggtgcggctgctgaccaagccctgggacgtcatccccatggtgacccagatcgccatgacggacaccaccccgttcgggcagcagcgcgtcttcaaggagaaggtggacacccggacgccccgcgccaagcggggcaccacccagatcatggaggtgaccgccaagtggctctggggcttcctgtcccgcaacaagaagccccggatctgcacgcgcgaggagttcacccggaaggtccgcagcaacgccgcgatcggggccgtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgcggacgacaccgccgggtgggacacgcggatcaccgaggacgacctccagaacgaggccaagatcaccgacatcatggagcccgagcacgccctgctggccaccagcatcttcaagctcacgtaccagaacaaggtggtgcgcgtccagcgccccgcgaagaacggcaccgtgatggacgtgatctcccggcgcgaccagcgggggagcggccaggtcggcacctacgggctgaacaccttcacgaacatggaggtgcagctgatccgccagatggagtccgagggcatcttcctccccagcgagctggagaccccgaacctggccgagcgggtgctcgactggctggagaagcacggggccgagcgcctgaagcggatggccatctccggcgacgactgcgtcgtgaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgctccgcggtgcccgtcgactgggtgcccacgagccgcaccacctggagcatccacgcccaccaccagtggatgaccacggaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcaccgcccgcgccacctgggccacgaacatccaggtcgcgatcaaccaggtgcggcgcctgatcgggaacgagaactacctggactacatgacctccatgaagcggttcaagagcgagtccgaccccgagggcgccctctggtga

SEQ ID NO: 8127 - RNA, 9879 nt, synthetic construct
  misc_feature 1..9879: note = derived and/or modified CDS sequence (opt1) from DENV-1__EU482616__SS-prME
  source 1..9879: mol_type = other RNA
agcgtgaccatgctgctcatgctgctgcccaccgccctcgccttccacctgaccacccggggcggggagccccacatgatcgtgaacaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgctcccagaccggcgagcaccggcgggacaagcgcagcgtggccctggcgccccacgtgggcctggggctcgagacgcggaccgagacctggatgtccagcgagggcgcctggaagcagatccagcgggtcgagacctgggccctgcggcaccccgggttcacggtgatcgccctgttcctcgcgcacgccatcggcacctccatcacccagaaggggatcatcttcatcctgctgatgctcgtgacccccagcatggccatgcgctgcgtcggcatcggcaaccgggacttcgtggaggggctgtccggcgccacgtgggtggacgtcgtgctggagcacgggagctgcgtgaccaccatggccaagaacaagcccaccctcgacatcgagctgctgaagacggaggtcaccaaccccgcgatcctccgcaagctgtgcatcgaggccaagatctccaacaccaccacggacagccggtgcccgacccagggcgaggccaccctggtggaggagcaggacgccaacttcgtgtgccgccggaccttcgtcgaccgcggctgggggaacggctgcggcctcttcggcaaggggtccctgctgacgtgcgccaagttcaagtgcgtgaccaagctcgagggcaagatcgtgcagtacgagaacctgaagtacagcgtcatcgtgaccgtgcacaccggcgaccagcaccaggtcgggaacgagacgaccgagcacggcaccatcgcgaccatcacgccccaggcccccacgtccgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggaccagcggggcctccaccagccaggagacctggaaccgccaggacctcctggtgacgttcaagaccgcccacgcgaagaagcaggaggtggtcgtgctgggcagccaggagggcgccatgcacaccgccctcaccggggccacggagatccagacctccggcaccaccacgatcttcgccgggcacctgaagtgccggctgaagatggacaagctcaccctgaagggcaccagctacgtgatgtgcaccgggtccttcaagctggagaaggaggtcgcggagacgcagcacggcaccgtgctggtgcaggtcaagtacgagggcaccgacgccccctgcaagatccccttcagcacccaggacgagaagggggtgacgcagaacggccgcctcatcaccgccaacccgatcgtgaccgacaaggagaagcccgtcaacatcgagaccgagccgcccttcggggagtcctacatcgtggtgggcgccggcgagaaggcgctgaagctgagctggttcaagaaggggtccagcatcggcaagatgttcgaggccacggcccgcggggcccgccggatggccatcctcggcgacaccgcgtgggacttcgggtccatcggcggcgtcttcaccagcgtggggaagctggtgcaccaggtcttcggcaccgcctacggggtgctgttctccggcgtgagctggacgatgaagatcgggatcggcatcctcctgacctggctgggcctcaactcccgcagcacctccctgagcatgacctgcatcgccgtcgggatggtgacgctgtacctcggcgtgatggtccaggccgactccgggtgcgtgatcaactggaagggccgcgagctgaagtgcgggagcggcatcttcgtgaccaacgaggtccacacctggaccgagcagtacaagttccaggccgactccccgaagcggctgagcgcggccatcggcaaggcctgggaggagggggtgtgcggcatccgcagcgccacccggctcgagaacatcatgtggaagcagatctccaacgagctgaaccacatcctgctcgagaacgacatgaagttcacggtggtcgtgggggacgccaacggcatcctggcgcaggggaagaagatgatccgcccccagcccatggagcacaagtacagctggaagtcctggggcaaggccaagatcatcggcgccgacatccagaacaccaccttcatcatcgacgggcccgacaccccggagtgccccgacgaccagcgggcctggaacatctgggaggtggaggactacggcttcgggatcttcacgaccaacatctggctgaagctccgcgacagctacacccagatgtgcgaccaccggctgatgtccgcggccatcaaggacagcaaggccgtccacgccgacatgggctactggatcgagtccgagaagaacgagacctggaagctggcccgcgcgagcttcatcgaggtgaagacgtgcacctggcccaagtcccacaccctctggagcaacggcgtgctggagtccgagatgatcatccccaagatctacgggggcccgatcagccagcacaactaccggcccgggtacttcacccagacggccggcccctggcacctggggaagctcgagctggacttcgacctgtgcgagggcaccaccgtcgtggtggacgagcactgcggcaaccgcgggccgtccctccggaccacgaccgtcaccggcaagatcatccacgagtggtgctgccgcagctgcaccctgccgcccctgcggttccgcggggaggacggctgctggtacgggatggagatccggcccgtgaaggagaaggaggagaacctcgtgcgctccatggtcagcgccggctccggcgaggtggacagcttcagcctggggatcctgtgcgcctccatcatgatcgaggaggtgatgcggagccgctggtcccggaagatgctcatgacgggcaccctggccgtcttcctgctcctgatcatggggcagctgacctggaacgacctcatccgcctgtgcatcatggtgggcgcgaacgccagcgaccgcatggggatgggcaccacgtacctggccctcatggccaccttcaagatgcggccgatgttcgccgtggggctgctgttccgccggctcacctcccgcgaggtcctgctgctcaccatcgggctgagcctggtggcgtccgtggagctccccaacagcctggaggagctgggcgacgggctcgccatgggcatcatgatgctgaagctgctcacggagttccagccccaccagctgtggaccaccctgctctccctgaccttcatcaagacgaccctgagcctcgactacgcctggaagaccaccgccatggcgctgtccatcgtcagcctgttccccctctgcctgtccacgaccagccagaagaccacctggctgccggtgctcctgggctccttcgggtgcaagcccctgaccatgttcctcatcacggagaacaagatctggggccgcaagagctggcccctgaacgaggggatcatggccatcggcatcgtctccatcctgctcagctccctgctgaagaacgacgtgcccctcgccgggccgctgatcgccggcggcatgctgatcgcctgctacgtgatcagcgggagctccgcggacctcagcctggagaaggccgccgaggtctcctgggagcaggaggccgagcacagcggcacctcccacaacatcctggtggaggtgcaggacgacgggaccatgaagatcaaggacgaggagaaggacgacaccctcacgatcctgctgaaggccaccctcctggcggtcagcggcgtgtaccccatgtccatccccgccaccctgttcgtgtggtacttctggcagaagaagaagcagcgcagcggggtcctctgggacaccccctccccgcccgaggtggagcgggccgtgctggacgacggcatctaccgcatcctgcagcggggcctgctcgggcgcagccaggtcggcgtgggggtgttccaggacggcgtcttccacacgatgtggcacgtgacccgcggggccgtgctgatgtaccagggcaagcgcctggagccctcctgggccagcgtcaagaaggacctcatctcctacggcgggggctggcggttccaggggagctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcacctccgggagcccgatcgtcaaccgcgagggcaagatcgtgggcctgtacgggaacggcgtggtcacgacctccgggacctacgtgagcgccatcgcccaggcgaaggcctcccaggagggccccctccccgagatcgaggacgaggtgttcaagaagcggaacctgaccatcatggacctgcacccggggagcggcaagacgcgccggtacctccccgccatcgtccgcgaggccatcaagcggaagctgcgcaccctgatcctcgcgcccacccgggtggtggccagcgagatggccgaggccctgaagggcatgcccatccgctaccagaccacggccgtcaagtccgagcacaccgggcgcgagatcgtggacctgatgtgccacgcgaccttcaccatgcggctcctgagcccggtgcgcgtccccaactacaacatgatcatcatggacgaggcccacttcacggaccccgcctccatcgccgcccggggctacatcagcacccgcgtggggatgggcgaggcggccgccatcttcatgaccgccacgccgcccgggtccgtggaggccttcccccagagcaacgcggtcatccaggacgaggagcgggacatccccgagcgctcctggaacagcggctacgactggatcacggacttccccggcaagaccgtgtggttcgtgccctccatcaagagcgggaacgacatcgccaactgcctgcggaagaacggcaagcgcgtcatccagctctcccggaagaccttcgacaccgagtaccagaagacgaagaacaacgactgggactacgtggtgaccaccgacatcagcgagatgggggccaacttccgcgccgaccgggtcatcgacccccgccggtgcctgaagcccgtgatcctgaaggacggccccgagcgcgtgatcctcgcggggccgatgcccgtcaccgtggcctccgccgcccagcggcgcggccggatcggccgcaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgggagaagtccgccgccatcgacggcgagtaccgcctgcgcggggaggcccggaagaccttcgtcgagctcatgcgccggggcgacctgcccgtgtggctgtcctacaaggtcgcgagcgagggcttccagtactccgaccgccggtggtgcttcgacggggagcgcaacaaccaggtgctcgaggagaacatggacgtggagatctggaccaaggagggcgagcggaagaagctgcgcccccggtggctggacgcccgcacctacagcgacccgctcgccctgcgggagttcaaggagttcgccgccgggcgccggtccgtcagcggcgacctgatcctcgagatcggcaagctgccccagcacctgacgctccgcgcgcagaacgccctggacaacctggtgatgctccacaacagcgagcagggcgggaaggcctaccggcacgccatggaggagctgcccgacaccatcgagaccctgatgctcctggcgctgatcgccgtgctcaccgggggcgtcacgctgttcttcctgtccgggaagggcctcggcaagaccagcatcgggctgctgtgcgtgaccgcctccagcgccctcctgtggatggcctccgtggagccccactggatcgcggccagcatcatcctggagttcttcctcatggtcctgctgatcccggagcccgaccgccagcggacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcgcccggcctccgcctggacgctctacgcggtcgccaccaccgtgatcacccccatgatgcggcacacgatcgagaacaccaccgccaacatcagcctgaccgccatcgccaaccaggcggccatcctgatgggcctcgacaagggctggcccatctccaagatggacatcggggtgcccctgctggccctcggctgctacagccaggtcaacccgctgacgctgaccgccgcggtgctcatgctggtggcccactacgccatcatcgggcccggcctgcaggccaaggccacccgcgaggcgcagaagcggaccgccgccgggatcatgaagaaccccacggtcgacggcatcgtggccatcgacctcgaccccgtggtctacgacgccaagttcgagaagcagctgggccagatcatgctgctcatcctgtgcacctcccagatcctgctcatgcgcaccacctgggcgctgtgcgagagcatcacgctggccaccgggccgctcaccaccctgtgggagggctcccccgggaagttctggaacacgaccatcgccgtgagcatggccaacatcttccgcggctcctacctggccggcgcggggctcgccttcagcctgatgaagtccctgggcgggggccggcgcgggaccggcgcccagggcgagaccctcggggagaagtggaagcggcagctgaaccagctgagcaagtccgagttcaacacgtacaagcgcagcggcatcatggaggtggaccggagcgaggccaaggaggggctcaagcgcggcgagaccaccaagcacgcggtctcccgggggaccgccaagctgcgctggttcgtggagcggaacctggtgaagcccgagggcaaggtcatcgacctgggctgcgggcgcggcgggtggagctactactgcgccggcctcaagaaggtgaccgaggtgaaggggtacacgaagggcggccccgggcacgaggagccgatccccatggccacctacggctggaacctggtcaagctgcactccgggaaggacgtgttcttcatgccgcccgagaagtgcgacaccctcctgtgcgacatcggcgagagctccccgaaccccaccatcgaggaggggcggacgctgcgcgtgctcaagatggtcgagccctggctgcggggcaaccagttctgcatcaagatcctgaacccctacatgccgagcgtggtggagaccctcgagcagatgcagcgcaagcacggcgggatgctggtccggaaccccctgtcccgcaacagcacccacgagatgtactgggtgtcctgcggcaccgggaacatcgtgagcgccgtcaacatgacgtcccggatgctcctgaaccgcttcaccatggcgcaccggaagcccacctacgagcgcgacgtggacctgggcgccggcacccgccacgtggccgtcgagcccgaggtggccaacctcgacatcatcgggcagcggatcgagaacatcaagaacgagcacaagagcacgtggcactacgacgaggacaacccgtacaagacctgggcctaccacggctcctacgaggtgaagcccagcgggtccgcgagctccatggtcaacggcgtggtgcgcctgctgaccaagccctgggacgtcatccccatggtgacccagatcgccatgacggacaccaccccgttcgggcagcagcgggtcttcaaggagaaggtggacacccgcacgccccgggccaagcgcggcaccacccagatcatggaggtgaccgccaagtggctctggggcttcctgagccggaacaagaagccccgcatctgcacgcgggaggagttcacccgcaaggtccggtccaacgccgcgatcggggccgtgttcgtggacgagaaccagtggaacagcgccaaggaggccgtcgaggacgagcgcttctgggacctggtgcaccgggagcgcgagctccacaagcagggcaagtgcgcgacctgcgtgtacaacatgatggggaagcgggagaagaagctgggcgagttcgggaaggccaagggcagccgcgccatctggtacatgtggctgggcgcccggttcctcgagttcgaggccctggggttcatgaacgaggaccactggttctcccgcgagaacagcctgtccggcgtcgagggggagggcctccacaagctggggtacatcctgcgggacatcagcaagatcccgggcggcaacatgtacgcggacgacaccgccgggtgggacacgcgcatcaccgaggacgacctccagaacgaggccaagatcaccgacatcatggagcccgagcacgccctgctggccacctccatcttcaagctcacgtaccagaacaaggtggtgcgggtccagcgccccgcgaagaacggcaccgtgatggacgtgatcagccgccgggaccagcgcgggtccggccaggtcggcacctacgggctgaacaccttcacgaacatggaggtgcagctgatccggcagatggagagcgagggcatcttcctcccctccgagctggagaccccgaacctggccaagcgcgtgctcgactggctggagaagcacggggccgagcggctgaagcgcatggccatcagcggcgacgactgcgtcgtgaagcccatcgacgaccggttcgccaccgcgctcaccgccctgaacgacatggggaaggtgcgcaaggacatcccccagtgggagccctccaagggctggaacgactggcagcaggtcccgttctgcagccaccacttccaccagctgatcatgaaggacggccgggagatcgtggtgccctgccgcaaccaggacgagctcgtcgggcgggcccgcgtgtcccagggcgccgggtggagcctgcgggagaccgcctgcctgggcaagtcctacgcgcagatgtggcagctcatgtacttccaccgccgggacctgcgcctggccgccaacgccatctgcagcgcggtgcccgtcgactgggtgcccacgtcccggaccacctggagcatccacgcccaccaccagtggatgaccacggaggacatgctcagcgtgtggaaccgcgtctggatcgaggagaacccgtggatggaggacaagacccacgtgtccagctgggaggaggtgccctacctggggaagcgggaggaccagtggtgcggctccctgatcggcctcaccgcccgcgccacctgggccacgaacatccaggtcgcgatcaaccaggtgcgccggctgatcgggaacgagaactacctggactacatgaccagcatgaagcgcttcaagaacgagtccgaccccgagggcgccctctggtga

SEQ ID NO: 8128 - RNA, 9879 nt, synthetic construct
  misc_feature 1..9879: note = derived and/or modified CDS sequence (opt1) from DENV-1__EU482618__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgcggtcagccgcgggaccgccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacacgaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccaccatcgaggaggggcgcacgctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacccacgagatgtactgggtgagctgcggcaccgggaacatcgtgtccgccgtcaacatgacgagccgcatgctcctgaaccggttcaccatggcgcaccgcaagcccacctacgagcgcgacgtggacctgggcgccggcacccggcacgtggccgtcgagcccgaggtggccaacctcgacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtcaacggcgtggtgcggctgctgaccaagccctgggacgtcatccccatggtgacccagatcgccatgacggacaccaccccgttcgggcagcagcgcgtcttcaaggagaaggtggacacccggacgccccgcgccaagcggggcaccacccagatcatggaggtgaccgccaagtggctctggggcttcctgtcccgcaacaagaagccccggatctgcacgcgcgaggagttcacccggaaggtccgcagcaacgccgcgatcggggccgtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgcggacgacaccgccgggtgggacacgcggatcaccgaggacgacctccagaacgaggccaagatcaccgacatcatggagcccgagcacgccctgctggccaccagcatcttcaagctcacgtaccagaacaaggtggtgcgcgtccagcgccccgcgaagaacggcaccgtgatggacgtgatctcccggcgcgaccagcgggggagcggccaggtcggcacctacgggctgaacaccttcacgaacatggaggtgcagctgatccgccagatggagtccgagggcatcttcctccccagcgagctggagaccccgaacctggccgagcgggtgctcgactggctggagaagcacggggccgagcgcctgaagcggatggccatctccggcgacgactgcgtcgtgaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgctccgcggtgcccgtcgactgggtgcccacgagccgcaccacctggagcatccacgcccaccaccagtggatgaccacggaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcaccgcccgcgccacctgggccacgaacatccaggtcgcgatcaaccaggtgcggcgcctgatcgggaacgagaactacctggactacatgacctccatgaagcggttcaagaacgagagcgaccccgagggcgccctctggtga

SEQ ID NO: 8129 - RNA, 9879 nt, synthetic construct
  misc_feature 1..9879: note = derived and/or modified CDS sequence (opt1) from DENV-1__EU482619__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgcggtcagccgcgggaccgccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacacgaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccaccatcgaggaggggcgcacgctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacccacgagatgtactgggtgagctgcggcaccgggaacatcgtgtccgccgtcaacatgacgagccgcatgctcctgaaccggttcaccatggcgcaccgcaagcccacctacgagcgcgacgtggacctgggcgccggcacccggcacgtggccgtcgagcccgaggtggccaacctcgacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtcaacggcgtggtgcggctgctgaccaagccctgggacgtcatccccatggtgacccagatcgccatgacggacaccaccccgttcgggcagcagcgcgtcttcaaggagaaggtggacacccggacgccccgcgccaagcggggcaccacccagatcatggaggtgaccgccaagtggctctggggcttcctgtcccgcaacaagaagccccggatctgcacgcgcgaggagttcacccggaaggtccgcagcaacgccgcgatcggggccgtgttcatcgacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacaccgccgggtgggacacgcgggtcaccgaggacgacctccagaacgaggccaagatcaccgacatcatggagcccgagcacgccctgctggccaccagcatcttcaagctcacgtaccagaacaaggtggtgcgcgtccagcgccccgcgaagaacggcaccgtgatggacgtgatctcccggcgcgaccagcgggggagcggccaggtcggcacctacgggctgaacaccttcacgaacatggaggtgcagctgatccgccagatggagtccgagggcatcttcctccccagcgagctggagaccccgaacctggccgagcgggtgctcgactggctggagaagcacggggccgagcgcctgcggcgcatggccatctccggcgacgactgcgtcgtgaagcccatcgacgaccggttcgccaccgcgctcaccgccctgaacgacatggggaaggtgcgcaaggacatcccccagtgggagcccagcaagggctggaacgactggcagcaggtcccgttctgctcccaccacttccaccagctgatcatgaaggacggccgggagatcgtggtgccctgccgcaaccaggacgagctcgtcgggcgggcccgcgtgagccagggcgccgggtggtccctgcgggagaccgcctgcctgggcaagagctacgcgcagatgtggcagctcatgtacttccaccgccgggacctgcgcctggccgccaacgccatctgctccgcggtgcccgtcgactgggtgcccacgagccggaccacctggagcatccacgcccaccaccagtggatgaccacggaggacatgctctccgtgtggaaccgcgtctggatcgaggagaacccgtggatggaggacaagacccacgtgagctcctgggaggaggtgccctacctggggaagcgcgaggaccagtggtgcggcagcctgatcggcctcaccgcccgggccacctgggccacgaacatccaggtcgcgatcaaccaggtgcgccggctgatcgggaacgagaactacctggactacatgacctccatgaagcgcttcaagaacgagagcgaccccgagggcgccctctggtga

SEQ ID NO: 8130 - RNA, 9879 nt, synthetic construct
  misc_feature 1..9879: note = derived and/or modified CDS sequence (opt1) from DENV-1__FJ898433__SS-prME
  source 1..9879: mol_type = other RNA
agcgtgaccatgctgctcatgctgctgcccaccgccctcgccttccacctgacgacccggggcggggagccccacatgatcgtgagcaagcaggagcggggcaagagcctcctcttcaagaccagcgccggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtcacctacgggacctgcagccagaccggcgagcaccggcgggagaagcgctccgtggccctggcgccccacgtgggcctggggctcgagacgcggaccgagacctggatgagctccgagggcgcctggaagcagatccagcgggtcgagacctgggccctgcggcaccccgggttcacggtgaccgccctgttcctcgcgcacgccatcggcaccagcatcacccagaaggggatcatcttcatcctgctgatgctcgtgacgccctccatggccatgcgctgcgtcggcatcggcaaccgggacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgcgatcctccgcaagctgtgcatcgaggccaagatcagcaacaccacgaccgactcccggtgccccacccagggcgaggccaccctggtggaggagcaggacgccaacttcgtgtgccgccggacgttcgtcgaccgcggctgggggaacggctgcggcctcttcggcaaggggagcctgctgacctgcgccaagttcaagtgcgtgaccaagctcgagggcaagatcgtgcagtacgagaacctgaagtactccgtcatcgtgaccgtgcacacgggcgaccagcaccaggtcgggaacgagaccaccgagcacggcaccatcgcgaccatcacgccccaggcccccaccagcgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggacctccggggccagcaccagccaggagacgtggaaccgccaggacctcctggtgaccttcaagaccgcccacgcgaagaagcaggaggtggtcgtgctgggctcccaggagggcgccatgcacaccgccctcacgggggccaccgagatccagaccagcggcaccacgaccatcttcgccgggcacctgaagtgccggctgaagatggacaagctcaccctgaagggcacctcctacgtgatgtgcacggggagcttcaagctggagaaggaggtcgcggagacccagcacggcaccgtgctggtgcaggtcaagtacgagggcaccgacgccccctgcaagatccccttctccacgcaggacgagaagggggtgacccagaacggccgcctcatcaccgccaacccgatcgtgaccgacaaggagaagcccgtcaacatcgagacggagccgcccttcggggagagctacatcgtggtgggcgccggcgagaaggcgctgaagctgtcctggttcaagaaggggagctccatcggcaagatgttcgaggccaccgcccgcggggcgcgccggatggccatcctcggcgacaccgcgtgggacttcgggagcatcggcggcgtcttcacctccgtggggaagctggtgcaccaggtcttcggcacggcctacggggtgctgttcagcggcgtgtcctggaccatgaagatcgggatcggcatcctcctgacctggctgggcctcaacagccgctccaccagcctgtccatgacgtgcatcgccgtcgggatggtgaccctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacgcggctcgagaacatcatgtggaagcagatcagcaacgagctgaaccacatcctgctcgagaacgacatgaagttcaccgtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacacgccggagtgccccgacaaccagcgggcctggaacatctgggaggtggaggactacggcttcgggatcttcaccaccaacatctggctgaagctccgcgactcctacacccagatgtgcgaccaccggctgatgagcgcggccatcaaggactccaaggccgtccacgccgacatgggctactggatcgagagcgagaagaacgagacgtggaagctggcccgcgcgtccttcatcgaggtgaagacctgcacctggcccaagagccacaccctctggtccaacggcgtgctggagagcgagatgatcatccccaagatctacgggggcccgatctcccagcacaactaccggcccgggtacttcacgcagaccgccggcccctggcacctggggaagctcgagctggacttcgacagctgcgagggcaccaccgtcgtggtggacgagcactgcggcaaccgcgggccgtccctgcggacgaccaccgtcaccggcaagatcatccacgagtggtgctgccgcagctgcacgctgccgcccctgcggttccgcggggaggacggctgctggtacgggatggagatccggcccgtgaaggagaaggaggagaacctggtgcgctccatggtcagcgccggcagcggcgaggtggactccttcagcctcgggatcctgtgcgtgtccatcatgatcgaggaggtcatgcggagccgctggtcccggaagatgctgatgaccggcaccctcgccgtgttcctgctgctcatcatggggcagctgacctggaaggacctgatccgcctctgcatcatggtgggcgccaacgcgagcgaccgcatggggatgggcacgacctacctggccctgatggccaccttcaagatgcggccgatgttcgccgtcggcctcctgttccgccggctgacctcccgcgaggtgctcctgctgacgatcgggctcagcctggtggcctccgtcgagctgcccaacagcctcgaggagctgggcgacgggctggcgatgggcatcatgatgctcaagctgctgaccgagttccacccccaccagctctggaccaccctgctgtccctcacgttcatcaagaccaccctgagcctggactacgcctggaagaccacggccatggccctctccatcgtgagcctgttccccctgtgcctctccaccaccagccagaagaccacctggctgccggtcctgctcggctccttcgggtgcaagcccctgacgatgttcctgatcaccgagaacaagatctggggccgcaagagctggcccctcaacgaggggatcatggcgatcggcatcgtgtccatcctgctgagcagcctcctgaagaacgacgtgcccctggccgggccgctcatcgccggcggcatgctgatcgcctgctacgtcatctccgggagctccgccgacctgagcctcgagaaggcggccgaggtgtcctgggagcaggaggccgagcacagcggcacctcccacaacatcctggtggaggtccaggacgacgggaccatgaagatcaaggacgaggagcgcgacgacacgctgaccatcctcctgaaggccaccctgctcgccgtgagcggcgtgtaccccatgtccatccccgcgaccctgttcgtctggtacttctggcagaagaagaagcagcggagcggggtgctgtgggacacgccctccccgcccgaggtggagcgcgccgtcctcgacgacggcatctaccggatcctgcagcgcggcctgctggggcggagccaggtgggcgtgggggtcttccaggacggcgtgttccacaccatgtggcacgtgacccgcggggccgtcctcatgtaccagggcaagcggctggagccctcctgggccagcgtgaagaaggacctgatctcctacggcgggggctggcgcttccaggggagctggaacaccggcgaggaggtgcaggtcatcgccgtggagcccgggaagaacccgaagaacgtgcagacgacccccggcaccttcaagacccccgagggcgaggtcggggcgatcgccctcgacttcaagcccggcacgtccgggagcccgatcgtgaaccgggagggcaagatcgtgggcctgtacgggaacggcgtcgtgaccacctccgggacctacgtgagcgccatcgcccaggccaaggcgagccaggagggccccctgcccgagatcgaggacgaggtcttcaagaagcgcaacctcacgatcatggacctgcacccggggtccggcaagacccggcgctacctgcccgccatcgtgcgggaggccatcaagcgcaagctccggaccctgatcctggcccccacccgcgtggtcgcgagcgagatggccgaggccctcaagggcatgcccatccgctaccagacgaccgccgtgaagtccgagcacaccgggcgggagatcgtggacctgatgtgccacgccaccttcacgatgcgcctgctcagcccggtccgggtgcccaactacaacatgatcatcatggacgaggcgcacttcaccgaccccgcctccatcgccgcccgcggctacatcagcacccgggtggggatgggcgaggccgcggccatcttcatgaccgccacgcccccggggtccgtcgaggccttcccccagagcaacgccgtgatccaggacgaggagcgcgacatccccgagcggtcctggaacagcggctacgactggatcaccgacttccccggcaagaccgtgtggttcgtcccgtccatcaagagcgggaacgacatcgcgaactgcctgcgcaagaacggcaagcgggtgatccagctgtcccgcaagaccttcgacacggagtaccagaagaccaagaacaacgactgggactacgtggtcaccaccgacatcagcgagatgggggccaacttccgggccgaccgcgtgatcgacccccggcgctgcctcaagcccgtgatcctgaaggacggccccgagcgggtcatcctggccgggccgatgcccgtgacggtggcgtccgccgcccagcgccggggccgcatcggccggaaccagaacaaggagggggaccagtacgtctacatgggccagcccctcaacaacgacgaggaccacgcccactggaccgaggccaagatgctgctggacaacatcaacacccccgaggggatcatcccggccctcttcgagcccgagcgcgagaagtccgccgccatcgacggcgagtaccgcctgcgcggggaggcccgcaagaccttcgtggagctgatgcggcgcggcgacctccccgtctggctgtcctacaaggtggccagcgagggcttccagtactccgaccggcgctggtgcttcgacggggagcggaacaaccaggtgctggaggagaacatggacgtcgagatctggaccaaggagggcgagcgcaagaagctccggccccgctggctggacgcgcggacgtacagcgacccgctggccctccgcgagttcaaggagttcgccgccgggcggcgcagcgtgtccggcgacctgatcctggagatcggcaagctcccccagcacctgaccctgcgggcccagaacgcgctcgacaacctggtgatgctgcacaacagcgagcagggcgggaaggcctaccgccacgccatggaggagctccccgacaccatcgagaccctgatgctgctcgccctgatcgcggtcctgaccggcggggtgaccctcttcttcctgtccgggaaggggctgggcaagaccagcatcgggctcctgtgcgtgaccgcctccagcgccctgctctggatggcctccgtcgagccccactggatcgccgcgagcatcatcctggagttcttcctgatggtgctcctgatcccggagcccgaccggcagcgcacgccccaggacaaccagctggcctacgtggtcatcggcctcctgttcatgatcctgaccgtggccgccaacgagatggggctcctggagaccaccaagaaggacctgggcatcgggcacgtggccgcggagaaccaccagcacgccacgatgctcgacgtcgacctgcggccggcctccgcctggaccctgtacgccgtggcgaccaccgtgatcacgcccatgatgcgccacaccatcgagaacaccaccgccaacatcagcctcacggccatcgccaaccaggccgcgatcctgatgggcctggacaagggctggcccatctccaagatggacatcggggtccccctcctggccctgggctgctacagccaggtgaacccgctcaccctgaccgccgccgtgctgatgctcgtcgcgcactacgccatcatcgggcccggcctgcaggccaaggccacccgggaggcccagaagcgcacggcggccgggatcatgaagaaccccaccgtggacggcatcgtggccatcgacctggaccccgtcgtgtacgacgccaagttcgagaagcagctcggccagatcatgctgctgatcctctgcacctcccagatcctgctgatgcgcaccacgtgggccctctgcgagagcatcaccctggcgaccgggccgctgaccacgctctgggagggctcccccgggaagttctggaacaccaccatcgccgtgagcatggccaacatcttccggggctcctacctggccggcgccgggctggcgttcagcctcatgaagtccctgggcgggggccgccgggggaccggcgcccagggcgagacgctgggggagaagtggaagcgccagctcaaccagctgagcaagagcgagttcaacacctacaagcggtccggcatcatggaggtcgaccgcagcgaggccaaggaggggctgaagcggggcgagaccaccaagcacgccgtgtcccgcgggaccgcgaagctccggtggttcgtggagcgcaacctggtcaagcccgagggcaaggtgatcgacctgggctgcgggcggggcgggtggagctactactgcgccggcctgaagaaggtgacggaggtcaaggggtacaccaagggcggccccgggcacgaggagccgatccccatggccacctacggctggaacctcgtgaagctgcactccgggaaggacgtgttcttcatgccgcccgagaagtgcgacaccctgctctgcgacatcggcgagagctccccgaaccccacgatcgaggaggggcgcaccctgcgggtcctgaagatggtggagccctggctccgcggcaaccagttctgcatcaagatcctgaacccctacatgccgagcgtggtcgagaccctggagcagatgcagcggaagcacggcgggatgctcgtgcgcaaccccctgtcccggaacagcacccacgagatgtactgggtgtcctgcggcacggggaacatcgtcagcgccgtgaacatgacctcccgcatgctgctcaaccggttcaccatggcccaccgcaagcccacctacgagaaggacgtggacctgggcgcgggcacgcgccacgtcgccgtggagcccgaggtggccaacctggacatcatcgggcagcggatcgagaacatcaagaacgagcacaagagcacctggcactacgacgaggacaacccgtacaagacctgggcctaccacggctcctacgaggtcaagcccagcgggtccgccagctccatggtgaacggcgtggtccgcctcctgaccaagccctgggacgtgatccccatggtcacgcagatcgcgatgaccgacaccaccccgttcgggcagcagcgggtgttcaaggagaaggtggacacgcgcacgccccgggccaagcgcggcaccacccagatcatggaggtcacggccaagtggctgtggggcttcctcagccggaacaagaagccccgcatctgcacccgggaggagttcacccgcaaggtgcggagcaacgccgccatcggggcggtgttcgtcgacgagaaccagtggaactccgccaaggaggccgtggaggacgagcgcttctgggacctggtgcaccgggagcgcgagctgcacaagcagggcaagtgcgcgacctgcgtctacaacatgatggggaagcgggagaagaagctcggcgagttcgggaaggcgaagggcagccgcgccatctggtacatgtggctgggcgcccggttcctggagttcgaggccctcgggttcatgaacgaggaccactggttctcccgcgagaacagcctgtccggcgtggagggggagggcctgcacaagctcgggtacatcctgcgggacatcagcaagatcccgggcggcaacatgtacgccgacgacacggcggggtgggacacccgcatcaccgaggacgacctgcagaacgaggccaagatcaccgacatcatggagcccgagcacgccctcctggccacgtccatcttcaagctgacctaccagaacaaggtggtccgggtgcagcgccccgccaagaacggcaccgtgatggacgtcatcagccgccgggaccagcgcgggtccggccaggtgggcacctacgggctcaacacgttcaccaacatggaggtgcagctgatccggcagatggagagcgagggcatcttcctgccctccgagctcgagaccccgaacctggcggagcgcgtcctggactggctcgggaagcacggcgccgagcggctgaagcgcatggccatcagcggggacgactgcgtggtgaagcccatcgacgaccggttcgccaccgccctgaccgcgctcaacgacatgggcaaggtccgcaaggacatcccccagtgggagccctccaagggctggaacgactggcagcaggtcccgttctgcagccaccacttccaccagctgatcatgaaggacgggcgggagatcgtggtcccctgccgcaaccaggacgagctggtgggccgggcccgcgtgtcccagggggccggctggagcctcaaggagacggcctgcctggggaagtcctacgcccagatgtggcagctgatgtacttccaccggcgcgacctccggctggcggccaacgccatctgcagcgccgtccccgtggactgggtgcccaccagccgcaccacctggtccatccacgcgcaccaccagtggatgacgaccgaggacatgctgagcgtctggaaccgggtgtggatcgaggagaacccgtggatggaggacaagacccacgtgtccagctgggaggaggtcccctacctcggcaagcgcgaggaccagtggtgcggctccctgatcgggctgaccgcccgggccacgtgggccaccaacatccaggtggccatcaaccaggtgcgccgcctcatcggcaacgagaactacctggactacatgaccagcatgaagcggttcaagaacgagtccgaccccgagggggcgctgtggtga

SEQ ID NO: 8131 - RNA, 9879 nt, synthetic construct
  misc_feature 1..9879: note = derived and/or modified CDS sequence (opt1) from DENV-1__FJ547088__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggggagctctgcgaggacaccatgacctacaagtgcccccagatcaccgaggccgagcccgacgacgtggactgctggtgcaacgccaccgacacctgggtcacctacgggacctgcagccagaccggggagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtgggcctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacaccaagttcgagaagcagctgggccagatcatgctgctcatcctgtgcaccagccagatcctgctcatgcgcaccacgtgggccctgtgcgagtccatcaccctggcgaccgggccgctcaccacgctgtgggagggcagccccgggaagttctggaacaccaccatcgccgtgtccatggccaacatcttccggggcagctacctggccggcgccgggctcgcgttctccctgatgaagtccctgggcgggggccgccgggggaccggcgcccagggcgagacgctcggggagaagtggaagcgccagctgaaccagctgtccaagagcgagttcaacatctacaagcggagcggcatcatggaggtggaccgctccgaggccaaggaggggctcaagcggggcgagaccaccaagcacgccgtcagccgcgggaccgcgaagctgcggtggttcgtggagcgcaacctggtgaagcccgagggcaaggtcatcgacctgggctgcgggcggggcgggtggtcctactactgcgccggcctcaagaaggtgaccgaggtgaaggggtacacgaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccaccatcgaggaggggcgcacgctgcgggtgctcaagatggtcgagccctggctgcgcggcaaccagttctgcatcaagatcctgaacccctacatgccgtccgtggtggagaccctcgagcagatgcagcggaagtacggcgggatgctggtccgcaaccccctgagccggaactccacccacgagatgtactgggtgagctgcggcaccgggaacatcgtgtccgccgtcaacatgacgagccgcatgctcctgaaccggttcaccatggcccaccgcaagcccacctacgagcgcgacgtggacctgggcgcgggcacccggcacgtggccgtcgagcccgaggtggccaacctcgacatcatcgggcagcgcatcgagaacatcaagaacgagcacaagtccacgtggcactacgacgaggacaacccgtacaagacctgggcctaccacggcagctacgaggtgaagccctccgggagcgcctccagcatggtcaacggcgtggtgcggctgctgaccaagccctgggacgtcatccccatggtgacccagatcgcgatgacggacaccaccccgttcgggcagcagcgcgtcttcaaggagaaggtggacacccggacgccccgcgccaagcggggcaccacccagatcatggaggtgaccgccaagtggctctggggcttcctgtcccgcaacaagaagccccggatctgcacgcgcgaggagttcacccggaaggtccgcagcaacgccgccatcggggcggtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggcgaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgccgacgacaccgcggggtgggacacgcggatcaccgaggacgacctccagaacgaggccaagatcaccgacatcatggagcccgagcacgccctgctggccaccagcatcttcaagctcacgtaccagaacaaggtggtgcgcgtccagcgccccgccaagaacggcaccgtgatggacgtgatctcccggcgcgaccagcgggggagcggccaggtcggcacctacgggctgaacaccttcacgaacatggaggtgcagctgatccgccagatggagtccgagggcatcttcctccccagcgagctggagaccccgaacctggcggggcgggtgctcgactggctggagaagcacggcgccgagcgcctgaagcggatggccatctccggggacgactgcgtcgtgaagcccatcgacgaccgcttcgccaccgccctcaccgcgctgaacgacatgggcaaggtgcggaaggacatcccccagtgggagcccagcaagggctggaacgactggcagcaggtcccgttctgctcccaccacttccaccagctgatcatgaaggacgggcgcgagatcgtggtgccctgccggaaccaggacgagctcgtcggccgcgcccgggtgagccagggggccggctggtccctgcgcgagaccgcctgcctgggcaagagctacgcccagatgtggcagctcatgtacttccaccggcgcgacctgcggctggcggccaacgccatctgctccgccgtgcccgtcgactgggtgcccacgagccgcaccacctggagcatccacgcgcaccaccagtggatgaccacggaggacatgctctccgtgtggaaccgggtctggatcgaggagaacccgtggatggaggacaagacccacgtgagctcctgggaggaggtgccctacctgggcaagcgcgaggaccagtggtgcggcagcctgatcgggctcaccgcccgcgccacctgggccacgaacatccaggtcgccatcaaccaggtgcggcgcctgatcggcaacgagaactacctggactacatgacctccatgaagcggttcaagaacgagagcgaccccgagggggcgctctggtga

SEQ ID NO: 8132 - RNA, 9879 nt, synthetic construct
  misc_feature 1..9879: note = derived and/or modified CDS sequence (opt1) from DENV-1__FJ810419__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgcccctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagaccagcgagggcgaggtgggggccatcgccctggacttcaagcccggcacctccgggagccccatcgtcaaccgggagggcaagatcgtgggcctgtacgggaacggcgtggtcacgacctccgggacctacgtgagcgccatcgcccaggcgaaggccagccaggagggcccgctccccgagatcgaggacgaggtgttcaagaagcgcaacctgaccatcatggacctgcaccccgggtccggcaagacgcggcgctacctcccggccatcgtccgggaggccatcaagcgcaagctgcggaccctgatcctcgcgcccacccgcgtggtggccagcgagatggccgaggccctgaagggcatgcccatccgctaccagaccacggccgtcaagtccgagcacaccgggcgggagatcgtggacctgatgtgccacgcgaccttcaccatgcgcctcctgagccccgtgcgggtcccgaactacaacatgatcatcatggacgaggcccacttcacggaccccgcctccatcgccgcccgcggctacatcagcacccgggtggggatgggcgaggcggccgccatcttcatgaccgccacgccgcccgggtccgtggaggccttcccgcagagcaacgcggtcatccaggacgaggagcgcgacatccccgagcggtcctggaacagcggctacgactggatcacggacttccccggcaagaccgtgtggttcgtgccctccatcaagagcgggaacgacatcgccaactgcctgcgcaagaacggcaagcgggtcatccagctctcccgcaagaccttcgacaccgagtaccagaagacgaagaacaacgactgggactacgtggtgaccaccgacatcagcgagatgggggccaacttccgggccgaccgcgtcatcgacccgcggcgctgcctgaagcccgtgatcctgaaggacggccccgagcgggtgatcctcgcggggcccatgccggtcaccgtggcctccgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatccccgccctgttcgagccggagcgcgagaagtccgccgccatcgacggcgagtaccgcctgcgcggggaggcccgcaagaccttcgtcgagctcatgcggcgcggcgacctgcccgtgtggctgtcctacaaggtcgcgagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacctacagcgaccccctcgccctgcgcgagttcaaggagttcgccgccgggcggcgcagcgtctccggcgacctgatcctcgagatcggcaagctgccgcagcacctgacgctccgggcgcagaacgccctggacaacctggtgatgctccacaacagcgagcagggcgggaaggcctaccgccacgccatggaggagctgcccgacaccatcgagaccctgatgctcctggcgctgatcgccgtgctcaccgggggcgtcacgctgttcttcctgtccgggaagggcctcggcaagaccagcatcgggctgctgtgcgtgaccgcctccagcgccctcctgtggatggcctccgtggagccccactggatcgcggccagcatcatcctggagttcttcctcatggtcctgctgatccccgagccggaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggcccgcctccgcctggacgctctacgcggtcgccaccaccgtgatcaccccgatgatgcgccacacgatcgagaacaccaccgccaacatcagcctgaccgccatcgccaaccaggcggccatcctgatgggcctcgacaagggctggcccatctccaagatggacatcggggtgcccctgctggccctcggctgctacagccaggtcaaccccctgacgctgaccgccgcggtgctcatgctggtggcccactacgccatcatcgggccgggcctgcaggccaaggccacccgggaggcgcagaagcgcaccgccgccgggatcatgaagaaccccacggtcgacggcatcgtggccatcgacctcgaccccgtggtctacgacgccaagttcgagaagcagctgggccagatcatgctgctcatcctgtgcacctcccagatcctgctcatgcgcaccacctgggcgctgtgcgagagcatcacgctggccaccgggcccctcaccaccctgtgggagggctccccggggaagttctggaacacgaccatcgccgtgagcatggccaacatcttccggggctcctacctggccggcgcggggctcgccttcagcctgatgaagtccctgggcgggggccgccgggggaccggcgcccagggcgagaccctcggggagaagtggaagcgccagctgaaccagctgagcaagagcgagttcaacacgtacaagcggtccggcatcatggaggtggaccgcagcgaggccaaggaggggctcaagcggggcgagaccaccaagcacgcggtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacacgaagggcggccccgggcacgaggagcccatcccgatggccacctacggctggaacctggtcaagctgtactccgggaaggacgtgttcttcatgccgcccgagaagtgcgacaccctcctgtgcgacatcggcgagagctcccccaacccgaccatcgaggaggggcgcacgctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccggaacagcacccacgagatgtactgggtgtcctgcggcaccgggaacatcgtgagcgccgtcaacatgacgtcccgcatgctcctgaaccggttcaccatggcgcaccgcaagcccacctacgagcgcgacgtggacctgggcgccggcacccggcacgtggccgtcgagcccgaggtggccaacctcgacatcatcgggcagcgcatcgagaacatcaagaacgagcacaagagcacgtggcactacgacgaggacaacccctacaagacctgggcctaccacggctcctacgaggtgaagccgagcgggtccgcgagctccatggtcaacggcgtggtgcggctgctgaccaagccctgggacgtcatccccatggtgacccagatcgccatgacggacaccacccccttcgggcagcagcgcgtcttcaaggagaaggtggacacccggacgccgcgcgccaagcggggcaccacccagatcatggaggtgaccgccaagtggctctggggcttcctgagccgcaacaagaagccccggatctgcacgcgcgaggagttcacccggaaggtccgcagcaacgccgcgatcggggccgtgttcgtggacgagaaccagtggaactccgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgcggacgacaccgccgggtgggacacgcggatcaccgaggacgacctccagaacgaggccaagatcaccgacatcatggagccggagcacgccctgctggccacctccatcttcaagctcacgtaccagaacaaggtggtgcgcgtccagcgccccgcgaagaacggcaccgtgatggacgtgatcagccggcgcgaccagcgggggtccggccaggtcggcacctacgggctgaacaccttcacgaacatggaggtgcagctgatccgccagatggagagcgagggcatcttcctcccctccgagctggagacccccaacctggccgagcgggtgctcgactggctggagaagcacggggccgagcgcctgaagcggatggccatcagcggcgacgactgcgtcgtgaagccgatcgacgaccgcttcgccaccgcgctcaccgccctgaacgacatggggaaggtgcggaaggacatcccccagtgggagccctccaagggctggaacgactggcagcaggtccccttctgcagccaccacttccaccagctgatcatgaaggacggccgcgagatcgtggtgccgtgccggaaccaggacgagctcgtcgggcgcgcccgggtgtcccagggcgccgggtggagcctgcgcgagaccgcctgcctgggcaagtcctacgcgcagatgtggcagctcatgtacttccaccggcgcgacctgcggctggccgccaacgccatctgcagcgcggtgcccgtcgactgggtgcccacgagccgcaccacctggtccatccacgcccaccaccagtggatgaccacggaggacatgctcagcgtgtggaaccgggtctggatcgaggagaacccctggatggaggacaagacccacgtgtccagctgggaggaggtgccgtacctggggaagcgcgaggaccagtggtgcggctccctgatcggcctcaccgcccgcgccacctgggccacgaacatccaggtcgcgatcaaccaggtgcggcgcctgatcgggaacgagaactacctggactacatgaccagcatgaagcggttcaagaacgagtccgaccccgagggcgccctctggtga

SEQ ID NO: 8133 - RNA, 9879 nt, synthetic construct
  misc_feature 1..9879: note = derived and/or modified CDS sequence (opt1) from DENV-1__FJ547068__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggcggccagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgcgatggccctgagcatcgtgtccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggccatcggcatcgtgagcatcctgctctccagcctgctgaagaacgacgtccccctcgccgggccgctgatcgccggcggcatgctgatcgcgtgctacgtgatcagcgggtccagcgccgacctctccctggagaaggccgccgaggtgagctgggagcaggaggccgagcactccggcaccagccacaacatcctggtcgaggtgcaggacgacgggaccatgaagatcaaggacgaggagcgcgacgacaccctcacgatcctgctgaaggcgaccctcctggccgtgtccggcgtctaccccatgagcatccccgccaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcgtccgtgaagaaggacctcatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggccatcgccctggacttcaagcccggcaccagcgggtccccgatcgtgaaccgggagggcaagatcgtcggcctgtacgggaacggcgtggtgacgaccagcgggacctacgtctccgccatcgcgcaggccaaggccagccaggagggccccctccccgagatcgaggacgaggtgttcaagaagcgcaacctgaccatcatggacctgcacccggggagcggcaagacgcggcgctacctccccgccatcgtgcgggaggcgatcaagcgcaagctgcggaccctgatcctcgcccccacccgcgtcgtggcctccgagatggccgaggccctgaagggcatgcccatccgctaccagaccacggcggtcaagagcgagcacaccgggcgggagatcgtcgacctgatgtgccacgccaccttcaccatgcgcctcctgtccccggtgcgggtgcccaactacaacatgatcatcatggacgaggcccacttcacggaccccgccagcatcgccgcgcgcggctacatctccacccgggtcgggatgggcgaggccgccgccatcttcatgaccgccacgccgcccgggagcgtggaggcgttcccccagtccaacgccgtgatccaggacgaggagcgcgacatccccgagcggagctggaactccggctacgactggatcacggacttccccggcaagaccgtctggttcgtgcccagcatcaagtccgggaacgacatcgccaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggcggaccgcgtgatcgacccccggcgctgcctgaagcccgtcatcctgaaggacggccccgagcgggtgatcctcgccgggccgatgcccgtgaccgtcgccagcgccgcccagcgccggggccgcatcggccggaaccagaacaaggagggggaccagtacgtgtacatgggccagcccctgaacaacgacgaggaccacgcgcactggacggaggccaagatgctgctcgacaacatcaacacccccgaggggatcatcccggccctgttcgagcccgagcgcgagaagtccgccgccatcgacggcgagtaccgcctgcgcggggaggcgcgcaagaccttcgtggagctcatgcggcgcggcgacctgcccgtctggctgagctacaaggtggcctccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcccggacctactccgacccgctcgccctgcgcgagttcaaggagttcgccgcggggcggcgcagcgtgagcggcgacctgatcctcgagatcggcaagctgccccagcacctgacgctccgggcccagaacgccctggacaacctggtcatgctccacaactccgagcagggcgggaaggcctaccgccacgcgatggaggagctgcccgacaccatcgagaccctgatgctcctggccctgatcgccgtgctcaccgggggcgtgacgctgttcttcctgagcgggaagggcctcggcaagacctccatcgggctgctgtgcgtcaccgccagctccgccctcctgtggatggcgagcgtggagccccactggatcgccgcctccatcatcctggagttcttcctcatggtgctgctgatcccggagcccgaccggcagcgcacgccccaggacaaccagctcgcctacgtcgtgatcggcctgctgttcatgatcctcacggtggccgcgaacgagatggggctgctggagaccaccaagaaggacctcggcatcgggcacgtcgccgccgagaaccaccagcacgccaccatgctggacgtggacctgcggccggccagcgcgtggacgctctacgccgtggccaccaccgtcatcacccccatgatgcgccacacgatcgagaacaccaccgccaacatctccctgaccgccatcgcgaaccaggccgccatcctgatgggcctcgacaagggctggcccatcagcaagatggacatcggggtgcccctgctggccctcggctgctactcccaggtgaacccgctgacgctgaccgcggccgtcctcatgctggtggcccactacgccatcatcgggcccggcctgcaggccaaggcgacccgggaggcccagaagcgcaccgccgccgggatcatgaagaaccccacggtggacggcatcgtcgccatcgacctcgaccccgtggtgtacgacgcgaagttcgagaagcagctgggccagatcatgctgctcatcctgtgcaccagccagatcctgctcatgcgcaccacctgggccctgtgcgagtccatcacgctggccaccgggccgctcaccaccctgtgggagggcagccccgggaagttctggaacacgaccatcgccgtctccatggccaacatcttccggggcagctacctggcgggcgccgggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggcgaaggaggggctcaagcggggcgagaccaccaagcacgccgtgagccgcgggaccgccaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacacgaagggcggccccgggcacgaggagccgatccccatggccacctacggctggaacctggtgaagctgcacagcgggaaggacgtcttcttcatgccgcccgagaagtgcgacaccctcctgtgcgacatcggcgagtccagcccgaaccccaccatcgaggaggggcgcacgctgcgggtgctcaagatggtggagccctggctgcgcggcaaccagttctgcatcaagatcctgaacccctacatgccgtccgtcgtggagaccctcgagcagatgcagcggaagcacggcgggatgctggtgcgcaaccccctgagccggaactccacccacgagatgtactgggtcagctgcggcaccgggaacatcgtgtccgcggtgaacatgacgagccgcatgctcctgaaccggttcaccatggcccaccgcaagcccacctacgagcgcgacgtcgacctgggcgccggcacccggcacgtggccgtggagcccgaggtcgccaacctcgacatcatcgggcagcgcatcgagaacatcaagaacgagcacaagtccacgtggcactacgacgaggacaacccgtacaagacctgggcgtaccacggcagctacgaggtgaagccctccgggagcgcctccagcatggtgaacggcgtcgtgcggctgctgaccaagccctgggacgtgatccccatggtcacccagatcgccatgacggacaccaccccgttcgggcagcagcgcgtgttcaaggagaaggtcgacacccggacgccccgcgccaagcggggcaccacccagatcatggaggtgaccgccaagtggctctggggcttcctgtcccgcaacaagaagccccggatctgcacgcgcgaggagttcacccggaaggtgcgcagcaacgcggccatcggggccgtcttcgtggacgagaaccagtggaacagcgccaaggaggcggtggaggacgagcggttctgggacctggtccaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggcgctggggttcatgaacgaggaccactggttcagccgggagaactccctgagcggcgtggagggggagggcctccacaagctggggtacatcctgcgcgacatctccaagatcccgggcggcaacatgtacgccgacgacaccgccgggtgggacacgcggatcaccgaggacgacctccagaacgaggccaagatcaccgacatcatggagcccgagcacgccctgctggcgaccagcatcttcaagctcacgtaccagaacaaggtcgtgcgcgtgcagcgccccgccaagaacggcaccgtcatggacgtgatctcccggcgcgaccagcgggggagcggccaggtgggcacctacgggctgaacaccttcacgaacatggaggtccagctgatccgccagatggagtccgagggcatcttcctccccagcgagctggagaccccgaacctggccgagcgggtgctcgactggctggagaagcacggggccgagcgcctgaagcggatggccatctccggcgacgactgcgtggtcaagcccatcgacgaccgcttcgcgaccgccctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctcgtggggcgcgcccgggtcagccagggcgccgggtggtccctgcgcgagaccgcgtgcctgggcaagagctacgcccagatgtggcagctcatgtacttccaccggcgcgacctgcggctggccgccaacgcgatctgctccgccgtgcccgtggactgggtccccacgagccgcaccacctggagcatccacgcccaccaccagtggatgaccacggaggacatgctctccgtgtggaaccgggtgtggatcgaggagaacccgtggatggaggacaagacccacgtcagctcctgggaggaggtgccctacctggggaagcgcgaggaccagtggtgcggcagcctgatcggcctcaccgcccgcgccacctgggcgacgaacatccaggtggccatcaaccaggtccggcgcctgatcgggaacgagaactacctggactacatgacctccatgaagcggttcaagaacgagagcgaccccgagggcgccctctggtga

SEQ ID NO: 8134 - RNA, 9879 nt, synthetic construct
  misc_feature 1..9879: note = derived and/or modified CDS sequence (opt1) from DENV-1__FJ562104__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacaccaagttcgagaagcagctgggccagatcatgctgctcatcctgtgcaccagccagatcctgctcatgcgcaccacgtgggccctgtgcgagtccatcaccctggcgaccgggccgctcaccacgctgtgggagggcagccccgggaagttctggaacaccaccatcgccgtgtccatggccaacatcttccggggcagctacctggccggcgccgggctcgcgttctccctgatgaagtccctgggcgggggccgccgggggaccggcgcccagggcgagacgctcggggagaagtggaagcgccagctgaaccagctgtccaagagcgagttcaacatctacaagcggagcggcatcatggaggtggaccgctccgaggccaaggaggggctcaagcggggcgagaccaccaagcacgccgtcagccgcgggaccgcgaagctgcggtggttcgtggagcgcaacctggtgaagcccgagggcaaggtcatcgacctgggctgcgggcggggcgggtggtcctactactgcgccggcctcaagaaggtgaccgaggtgaaggggtacacgaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccaccatcgaggaggggcgcacgctgcgggtgctcaagatggtcgagccctggctgcgcggcaaccagttctgcatcaagatcctgaacccctacatgccgtccgtggtggagaccctcgagcagatgcagcggaagtacggcgggatgctggtccgcaaccccctgagccggaactccacccacgagatgtactgggtgagctgcggcaccgggaacatcgtgtccgccgtcaacatgacgagccgcatgctcctgaaccggttcaccatggcccaccgcaagcccacctacgagcgcgacgtggacctgggcgcgggcacccggcacgtggccgtcgagcccgaggtggccaacctcgacatcatcgggcagcgcatcgagaacatcaagaacgagcacaagtccacgtggcactacgacgaggacaacccgtacaagacctgggcctaccacggcagctacgaggtgaagccctccgggagcgcctccagcatggtcaacggcgtggtgcggctgctgaccaagccctgggacgtcatccccatggtgacccagatcgcgatgacggacaccaccccgttcgggcagcagcgcgtcttcaaggagaaggtggacacccggacgccccgcgccaagcggggcaccacccagatcatggaggtgaccgccaagtggctctggggcttcctgtcccgcaacaagaagccccggatctgcacgcgcgaggagttcacccggaaggtccgcagcaacgccgccatcggggcggtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggcgaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgccgacgacaccgcggggtgggacacgcggatcaccgaggacgacctccagaacgaggccaagatcaccgacatcatggagcccgagcacgccctgctggccaccagcatcttcaagctcacgtaccagaacaaggtggtgcgcgtccagcgccccgccaagaacggcaccgtgatggacgtgatctcccggcgcgaccagcgggggagcggccaggtcggcacctacgggctgaacaccttcacgaacatggaggtgcagctgatccgccagatggagtccgagggcatcttcctccccagcgagctggagaccccgaacctggcggagcgggtgctcgactggctggagaagcacggggccgagcgcctgaagcggatggccatctccggcgacgactgcgtcgtgaagcccatcgacgaccgcttcgccaccgccctcaccgcgctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagaccgcctgcctgggcaagagctacgcccagatgtggcagctcatgtacttccaccggcgcgacctgcggctggcggccaacgccatctgctccgccgtgcccgtcgactgggtgcccacgagccgcaccacctggagcatccacgcgcaccaccagtggatgaccacggaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcaccgcccgcgccacctgggccacgaacatccaggtcgccatcaaccaggtgcggcgcctgatcgggaacgagaactacctggactacatgacctccatgaagcggttcaagaacgagagcgaccccgagggcgcgctctggtga

SEQ ID NO: 8135 - RNA, 9879 nt, synthetic construct
  misc_feature 1..9879: note = derived and/or modified CDS sequence (opt1) from DENV-1__GQ199857__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcatctccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggccatcggcatcgtgagcatcctgctctccagcctgctgaagaacgacgtccccctcgccgggccgctgatcgccggcggcatgctgatcgcctgctacgtgatcagcgggtccagcgcggacctctccctggagaaggccgccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggcggtgtccggcgtctaccccatgagcatccccgccaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgcggtggagcccgggaagaacccgaagaacgtccagaccacgcccggcaccttcaagacccccgagggcgaggtgggggccatcgccctggacttcaagcccggcaccagcgggtccccgatcgtgaaccgggagggcaagatcgtcggcctgtacgggaacggcgtggtgacgaccagcgggacctacgtctccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtgcgggaggccatcaagcgcaagctgcggaccctgatcctcgcgcccacccgcgtcgtggcctccgagatggccgaggccctgaagggcatgcccatccgctaccagaccacggccgtcaagagcgagcacaccgggcgggagatcgtcgacctgatgtgccacgcgaccttcaccatgcgcctcctgtccccggtgcgggtgcccaactacaacatgatcatcatggacgaggcccacttcacggaccccgccagcatcgccgcccgcggctacatctccacccgggtcgggatgggcgaggcggccgccatcttcatgaccgccacgccgcccgggagcgtggaggccttcccccagtccaacgcggtgatccaggacgaggagcgcgacatccccgagcggagctggaactccggctacgactggatcacggacttccccggcaagaccgtctggttcgtgcccagcatcaagtccgggaacgacatcgccaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgcggggccgatgcccgtgaccgtcgccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcgtccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgacgctccgggcgcagaacgccctggacaacctggtcatgctccacaactccgagcagggcgggaaggcctaccgccacgccatggaggagctgcccgacaccatcgagaccctgatgctcctggcgctgatcgccgtgctcaccgggggcgtgacgctgttcttcctgagcgggaagggcctcggcaagacctccatcgggctgctgtgcgtcaccgccagctccgccctcctgtggatggccagcgtggagccccactggatcgcggcctccatcatcctggagttcttcctcatggtgctgctgatcccggagcccgaccggcagcgcacgccccaggacaaccagctcgcctacgtcgtgatcggcctgctgttcatgatcctcacggtggccgccaacgagatggggctgctggagaccaccaagaaggacctcggcatcgggcacgtcgcggccgagaaccaccagcacgccaccatgctggacgtggacctgcggccggccagcgcctggacgctctacgcggtggccaccaccgtcatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtgaacccgctgacgctgaccgccgcggtcctcatgctggtggcccactacgccatcatcgggcccggcctgcaggccaaggccacccgggaggcgcagaagcgcaccgccgccgggatcatgaagaaccccacggtggacggcatcgtcgccatcgacctcgaccccgtggtgtacgacaccaagttcgagaagcagctgggccagatcatgctgctcatcctgtgcaccagccagatcctgctcatgcgcaccacgtgggccctgtgcgagtccatcaccctggcgaccgggccgctcaccacgctgtgggagggcagccccgggaagttctggaacaccaccatcgccgtctccatggccaacatcttccggggcagctacctggccggcgccgggctcgcgttctccctgatgaagtccctgggcgggggccgccgggggaccggcgcccagggcgagacgctcggggagaagtggaagcgccagctgaaccagctgtccaagagcgagttcaacatctacaagcggagcggcatcatggaggtggaccgctccgaggccaaggaggggctcaagcggggcgagaccaccaagcacgccgtgagccgcgggaccgcgaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacacgaagggcggccccgggcacgaggagccgatccccatggccacctacggctggaacctggtgaagctgcacagcgggaaggacgtcttcttcatgccgcccgagaagtgcgacaccctcctgtgcgacatcggcgagtccagcccgaaccccaccatcgaggaggggcgcacgctgcgggtgctcaagatggtggagccctggctgcgcggcaaccagttctgcatcaagatcctgaacccctacatgccgtccgtcgtggagaccctcgagcagatgcagcggaagtacggcgggatgctggtgcgcaaccccctgagccggaactccacccacgagatgtactgggtcagctgcggcaccgggaacatcgtgtccgccgtgaacatgacgagccgcatgctcctgaaccggttcaccatggcccaccgcaagcccacctacgagcgcgacgtcgacctgggcgcgggcacccggcacgtggccgtggagcccgaggtcgccaacctcgacatcatcgggcagcgcatcgagaacatcaagaacgagcacaagtccacgtggcactacgacgaggacaacccgtacaagacctgggcctaccacggcagctacgaggtgaagccctccgggagcgcctccagcatggtgaacggcgtcgtgcggctgctgaccaagccctgggacgtgatccccatggtcacccagatcgcgatgacggacaccaccccgttcgggcagcagcgcgtgttcaaggagaaggtcgacacccggacgccccgcgccaagcggggcaccacccagatcatggaggtgaccgccaagtggctctggggcttcctgtcccgcaacaagaagccccggatctgcacgcgcgaggagttcacccggaaggtgcgcagcaacgccgccatcggggcggtcttcatcgacgagaaccagtggaacagcgccaaggaggccgtggaggacgagcggttctgggacctggtgcaccgcgagcgggagctccacaagcagggcaagtgcgcgacctgcgtctacaacatgatggggaagcgcgagaagaagctgggcgagttcgggaaggcgaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgccgacgacaccgcggggtgggacacgcggatcaccgaggacgacctccagaacgaggccaagatcaccgacatcatggagcccgagcacgccctgctggccaccagcatcttcaagctcacgtaccagaacaaggtggtccgcgtgcagcgccccgccaagaacggcaccgtgatggacgtcatctcccggcgcgaccagcgggggagcggccaggtgggcacctacgggctgaacaccttcacgaacatggaggtgcagctgatccgccagatggagtccgagggcatcttcctccccagcgagctggagaccccgaacctggcggagcgggtcctcgactggctggagaagcacggggccgagcgcctgaagcggatggccatctccggcgacgactgcgtggtgaagcccatcgacgaccgcttcgccaccgccctcaccgcgctgaacgacatggggaaggtccggaaggacatcccccagtgggagcccagcaagggctggaacgactggcagcaggtcccgttctgctcccaccacttccaccagctgatcatgaaggacggccgcgagatcgtggtcccctgccggaaccaggacgagctcgtggggcgcgcccgggtgagccagggcgccgggtggtccctgcgcgagaccgcctgcctgggcaagagctacgcccagatgtggcagctcatgtacttccaccggcgcgacctgcggctggcggccaacgccatctgctccgccgtccccgtggactgggtgcccacgagccgcaccacctggagcatccacgcgcaccaccagtggatgaccacggaggacatgctctccgtctggaaccgggtgtggatcgaggagaacccgtggatggaggacaagacccacgtgagctcctgggaggaggtcccctacctggggaagcgcgaggaccagtggtgcggcagcctgatcggcctcaccgcccgcgccacctgggccacgaacatccaggtggccatcaaccaggtgcggcgcctgatcgggaacgagaactacctggactacatgacctccatgaagcggttcaagaacgagagcgaccccgagggcgcgctctggtga

SEQ ID NO: 8136 - RNA, 9879 nt, synthetic construct
  misc_feature 1..9879: note = derived and/or modified CDS sequence (opt1) from DENV-1__GQ199858__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcatctccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggccatcggcatcgtgagcatcctgctctccagcctgctgaagaacgacgtccccctcgccgggccgctgatcgccggcggcatgctgatcgcctgctacgtgatcagcgggtccagcgcggacctctccctggagaaggccgccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggcggtgtccggcgtctaccccatgagcatccccgccaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgcggtggagcccgggaagaacccgaagaacgtccagaccacgcccggcaccttcaagacccccgagggcgaggtgggggccatcgccctggacttcaagcccggcaccagcgggtccccgatcgtgaaccgggagggcaagatcgtcggcctgtacgggaacggcgtggtgacgaccagcgggacctacgtctccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtgcgggaggccatcaagcgcaagctgcggaccctgatcctcgcgcccacccgcgtcgtggcctccgagatggccgaggccctgaagggcatgcccatccgctaccagaccacggccgtcaagagcgagcacaccgggcgggagatcgtcgacctgatgtgccacgcgaccttcaccatgcgcctcctgtccccggtgcgggtgcccaactacaacatgatcatcatggacgaggcccacttcacggaccccgccagcatcgccgcccgcggctacatctccacccgggtcgggatgggcgaggcggccgccatcttcatgaccgccacgccgcccgggagcgtggaggccttcccccagtccaacgcggtgatccaggacgaggagcgcgacatccccgagcggagctggaactccggctacgactggatcacggacttccccggcaagaccgtctggttcgtgcccagcatcaagtccgggaacgacatcgccaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgcggggccgatgcccgtgaccgtcgccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcgtccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgacgctccgggcgcagaacgccctggacaacctggtcatgctccacaactccgagcagggcgggaaggcctaccgccacgccatggaggagctgcccgacaccatcgagaccctgatgctcctggcgctgatcgccgtgctcaccgggggcgtgacgctgttcttcctgagcgggaagggcctcggcaagacctccatcgggctgctgtgcgtcaccgccagctccgccctcctgtggatggccagcgtggagccccactggatcgcggcctccatcatcctggagttcttcctcatggtgctgctgatcccggagcccgaccggcagcgcacgccccaggacaaccagctcgcctacgtcgtgatcggcctgctgttcatgatcctcacggtggccgccaacgagatggggctgctggagaccaccaagaaggacctcggcatcgggcacgtcgcggccgagaaccaccagcacgccaccatgctggacgtggacctgcggccggccagcgcctggacgctctacgcggtggccaccaccgtcatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtgaacccgctgacgctgaccgccgcggtcctcatgctggtggcccactacgccatcatcgggcccggcctgcaggccaaggccacccgggaggcgcagaagcgcaccgccgccgggatcatgaagaaccccacggtggacggcatcgtcgccatcgacctcgaccccgtggtgtacgacaccaagttcgagaagcagctgggccagatcatgctgctcatcctgtgcaccagccagatcctgctcatgcgcaccacgtgggccctgtgcgagtccatcaccctggcgaccgggccgctcaccacgctgtgggagggcagccccgggaagttctggaacaccaccatcgccgtctccatggccaacatcttccggggcagctacctggccggcgccgggctcgcgttctccctgatgaagtccctgggcgggggccgccgggggaccggcgcccagggcgagacgctcggggagaagtggaagcgccagctgaaccagctgtccaagagcgagttcaacatctacaagcggagcggcatcatggaggtggaccgctccgaggccaaggaggggctcaagcggggcgagaccaccaagcacgccgtgagccgcgggaccgcgaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacacgaagggcggcctggggcacgaggagcccatcccgatggccacctacggctggaacctggtgaagctccacagcgggaaggacgtcttcttcatgccgcccgagaagtgcgacaccctgctgtgcgacatcggcgagtccagccccaacccgaccatcgaggaggggcgcacgctccgggtgctgaagatggtggagccctggctgcgcggcaaccagttctgcatcaagatcctcaacccctacatgccctccgtcgtggagaccctggagcagatgcagcggaagtacggcgggatgctggtgcgcaacccgctcagccggaactccacccacgagatgtactgggtcagctgcggcaccgggaacatcgtgtccgccgtgaacatgacgagccgcatgctgctgaaccggttcaccatggcccaccgcaagcccacctacgagcgcgacgtcgacctcggcgcgggcacccggcacgtggccgtggagcccgaggtcgccaacctggacatcatcgggcagcgcatcgagaacatcaagaacgagcacaagtccacgtggcactacgacgaggacaacccctacaagacctgggcctaccacggcagctacgaggtgaagccgtccgggagcgcctccagcatggtgaacggcgtcgtgcggctgctcaccaagccctgggacgtgatccccatggtcacccagatcgcgatgacggacaccacccccttcgggcagcagcgcgtgttcaaggagaaggtcgacacccggacgccgcgcgccaagcggggcaccacccagatcatggaggtgaccgccaagtggctgtggggcttcctgtcccgcaacaagaagccccggatctgcacgcgcgaggagttcacccggaaggtgcgcagcaacgccgccatcggggcggtcttcgtggacgagaaccagtggaacagcgccaaggaggccgtggaggacgagcggttctgggacctcgtccaccgcgagcgggagctgcacaagcagggcaagtgcgcgacctgcgtgtacaacatgatggggaagcgcgagaagaagctgggcgagttcgggaaggcgaagggctcccgggccatctggtacatgtggctcggcgcccgcttcctggagttcgaggccctggggttcatgaacgaggaccactggttcagccgggagaactccctcagcggcgtggagggggagggcctgcacaagctggggtacatcctccgcgacatctccaagatccccggcggcaacatgtacgccgacgacaccgcggggtgggacacgcggatcaccgaggacgacctgcagaacgaggccaagatcaccgacatcatggagccggagcacgccctgctcgccaccagcatcttcaagctgacgtaccagaacaaggtcgtgcgcgtgcagcgccccgccaagaacggcaccgtcatggacgtgatctcccggcgcgaccagcgggggagcggccaggtgggcacctacgggctgaacaccttcacgaacatggaggtccagctcatccgccagatggagtccgagggcatcttcctgcccagcgagctggagacccccaacctcgcggagcgggtgctggactggctggagaagcacggggccgagcgcctcaagcggatggccatctccggcgacgactgcgtggtcaagccgatcgacgaccgcttcgccaccgccctgaccgcgctgaacgacatggggaaggtgcggaaggacatcccccagtgggagcccagcaagggctggaacgactggcagcaggtccccttctgctcccaccacttccaccagctcatcatgaaggacggccgcgagatcgtcgtgccgtgccggaaccaggacgagctggtggggcgcgcccgggtcagccagggcgccgggtggtccctgcgcgagaccgcctgcctcggcaagagctacgcccagatgtggcagctgatgtacttccaccggcgcgacctgcggctcgcggccaacgccatctgctccgccgtgcccgtggactgggtccccacgagccgcaccacctggagcatccacgcgcaccaccagtggatgaccacggaggacatgctgtccgtgtggaaccgggtgtggatcgaggagaacccctggatggaggacaagacccacgtcagctcctgggaggaggtgccgtacctggggaagcgcgaggaccagtggtgcggcagcctcatcggcctgaccgcccgcgccacctgggccacgaacatccaggtggccatcaaccaggtccggcgcctgatcgggaacgagaactacctcgactacatgacctccatgaagcggttcaagaacgagagcgaccccgagggcgcgctgtggtga

SEQ ID NO: 8137 - RNA, 9879 nt, synthetic construct
  misc_feature 1..9879: note = derived and/or modified CDS sequence (opt1) from DENV-1__GQ199859__SS-prME
  source 1..9879: mol_type = other RNA
agcgtgaccatgctcctcatgctgctgcccaccgccctcgccttccacctgacgacccgcggcggggagccccacatgatcgtgagcaagcacgagcggggcaagagcctcctgttcaagaccagcaccggggtgaacatgtgcacgctgatcgccatggacctgggcgagctctgcgaggacaccatgacctacaagtgcccccgcatcaccgaggccgagcccgacgacgtggactgctggtgcaacgccacggacacctgggtgacctacgggacctgcagccagacgggcgagcaccggcgcgacaagcggtccgtggccctggcgccccacgtgggcctggggctcgagacccgcaccgagacctggatgagctccgagggcgcctggaagcagatccagcgggtggagacgtgggccctgcgccacccggggttcaccgtgatcgccctgttcctcgcccacgcgatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgccgtgctccggaagctgtgcatcgaggcgaagatcagcaacaccacgaccgactcccgctgccccacccagggcgaggccaccctggtggaggagcaggacgccaacttcgtctgccggcgcacgctcgtggaccggggctgggggaacggctgcgggctgttcggcaaggggagcctgctgacctgcgccaagttcaagtgcgtgaccaagctggagggcaagatcgtccagtacgagaacctgaagtactccgtgatcgtgaccgtccacacgggcgaccagcaccaggtggggaacgagaccaccgagcacggcaccatcgccaccatcacgccccaggcgcccaccagcgagatccagctcaccgactacggggccctgaccctggactgcagcccccggacgggcctcgacttcaacgagatggtcctgctgaccatgaaggagaagtcctggctcgtgcacaagcagtggttcctggacctgccgctcccctggacctccggggccagcaccagccaggagacgtggaaccggcaggacctgctggtgaccttcaagaccgcccacgccaagaagcaggaggtcgtggtgctcggctcccaggagggcgcgatgcacaccgccctgacgggggccaccgagatccagaccagcggcaccacgaccatcttcgccgggcacctgaagtgccgcctcaagatggacaagctgaccctgaagggcacctcctacgtcatgtgcacggggagcttcaagctggagaaggaggtggccgagacccagcacggcaccgtgctcgtccaggtgaagtacgagggcaccgacgcgccctgcaagatccccttctccacgcaggacgagaagggggtgacccagaacggccggctgatcaccgccaacccgatcgtcaccgacaaggagaagcccgtgaacatcgagacggagccgcccttcggggagagctacatcgtggtcggcgccggcgagaaggccctgaagctctcctggttcaagaaggggagctccatcggcaagatgttcgaggcgaccgcccgcggggcccggcgcatggccatcctgggcgacaccgcctgggacttcgggagcatcggcggcgtgttcacctccgtggggaagctggtccaccaggtgttcggcacggcgtacggggtcctcttcagcggcgtctcctggaccatgaagatcgggatcggcatcctgctgacctggctcggcctgaacagccgctccaccagcctgtccatgacgtgcatcgccgtggggatggtgaccctctacctgggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctcagcgccgcgatcggcaaggcctgggaggagggggtgtgcggcatccggtccgccacgcgcctggagaacatcatgtggaagcagatcagcaacgagctgaaccacatcctcctggagaacgacatgaagttcaccgtcgtggtgggggacgccaacggcatcctggcccaggggaagaagatgatccggccccagcccatggagcacaagtactcctggaagtcctggggcaaggcgaagatcatcggcgccgacatccagaacaccaccttcatcatcgacgggcccgacacgccggagtgccccgacgaccagcgcgcctggaacatctgggaggtcgaggactacggcttcgggatcttcaccaccaacatctggctcaagctgcgggactcctacacccagatgtgcgaccaccgcctgatgagcgccgcgatcaaggactccaaggccgtgcacgccgacatgggctactggatcgagagcgagaagaacgagacgtggaagctcgcccgggcctccttcatcgaggtgaagacctgcacctggcccaagagccacaccctgtggtccaacggcgtcctggagagcgagatgatcatccccaagatctacgggggcccgatctcccagcacaactaccgccccgggtacttcacgcagaccgcgggcccctggcacctcgggaagctggagctggacttcgacctctgcgagggcaccaccgtggtggtcgacgagcactgcggcaaccgggggccgagcctgcgcacgaccaccgtgaccggcaagatcatccacgagtggtgctgccggtcctgcacgctgccgcccctccgcttccgcggggaggacggctgctggtacgggatggagatccgccccgtgaaggagaaggaggagaacctggtccggagcatggtgtccgccggcagcggcgaggtggacagcttctccctggggatcctctgcgtcagcatcatgatcgaggaggtgatgcgctcccggtggagccgcaagatgctgatgaccggcaccctggccgtgttcctcctgctgatcatggggcagctcacctggaacgacctgatccgcctgtgcatcatggtcggcgccaacgcctccgaccggatggggatgggcacgacctacctcgcgctgatggccaccttcaagatgcgcccgatgttcgccgtgggcatcctgttccggcgcctcaccagccgggaggtgctgctgctcacgatcgggctgtccctggtcgccagcgtggagctccccaactccctggaggagctgggcgacgggctcgccatgggcatcatgatgctgaagctgctcaccgagttccagccccaccagctgtggaccaccctgctcagcctgacgttcatcaagaccaccctgtccctcgactacgcgtggaagaccacggccatggccctgagcatcgtctccctgttccccctctgcctgagcaccacctcccagaagaccacctggctgccggtgctcctgggcagcttcgggtgcaagcccctgacgatgtacctcatcaccgagaacaagatctggggccgcaagtcctggcccatcaacgaggggatcatggccatcggcatcgtgagcatcctgctgtccagcctcctgaagaacgacgtccccctggcggggccgctcatcgccggcggcatgctgatcgcctgctacgtgatcagcgggtccagcgccgacctgtccctcgagaaggccgcggaggtgagctgggagcaggaggccgagcactccggcaccagccacaacatcctggtcgaggtgcaggacgacgggaccatgcggatcaaggacgaggagaaggacgacacgctgaccatcctcctgaaggccaccctgctcgccgtgtccggcgtctaccccatgagcatccccgccaccctgttcgtgtggtacttctggcagaagaagaagcagcgctccggggtgctgtgggacacgcccagcccgcccgaggtcgagcgggcggtgctcgacgacggcatctaccgcatcctgcagcggggcctgctggggcgctcccaggtgggcgtcggggtgttccaggacggcgtgttccacaccatgtggcacgtcacccgcggggccgtgctcatgtaccagggcaagcgcctggagcccagctgggcctccgtgaagaaggacctgatcagctacggcgggggctggcggttccaggggtcctggaacaccggcgaggaggtccaggtgatcgccgtggagcccgggaagaacccgaagaacgtccagacgacccccggcaccttcaagacccccgagggcgaggtgggggccatcgcgctcgacttcaagcccggcacgagcgggtccccgatcgtgaaccgcgagggcaagatcgtcggcctgtacgggaacggcgtggtgaccaccagcgggacctacgtctccgccatcgcccaggccaaggccagccaggagggccccctgcccgagatcgaggacgaggtgttcaagaagcggaacctcacgatcatggacctgcacccggggagcggcaagacccgccggtacctgcccgcgatcgtgcgcgaggccatcaagcggaagctccgcaccctgatcctggcccccacccgcgtcgtggcctccgagatggcggaggccctcaagggcatgcccatccggtaccagacgaccgccgtcaagagcgagcacaccgggcgcgagatcgtcgacctgatgtgccacgccaccttcacgatgcggctgctctccccggtgcgcgtgcccaactacaacatgatcatcatggacgaggcccacttcaccgaccccgcgagcatcgccgcccggggctacatctccacccgcgtcgggatgggcgaggccgccgcgatcttcatgaccgccacgcccccggggagcgtggaggccttcccccagtccaacgccgtgatccaggacgaggagcgggacatccccgagcgcagctggaactccggctacgactggatcaccgacttccccggcaagaccgtctggttcgtgccgagcatcaagtccgggaacgacatcgccaactgcctgcggaagaacggcaagcgcgtgatccagctgagccggaagaccttcgacacggagtaccagaagaccaagaacaacgactgggactacgtcgtgaccaccgacatctccgagatgggggcgaacttccgcgccgaccgggtgatcgacccccgccggtgcctcaagcccgtcatcctgaaggacggccccgagcgcgtgatcctggccgggccgatgcccgtgacggtcgccagcgcggcccagcggcgcggccggatcggccgcaaccagaacaaggagggggaccagtacgtgtacatgggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgcgcggggaggcccggaagaccttcgtcgagctgatgcgccggggcgacctccccgtgtggctgagctacaaggtggcctccgagggcttccagtacagcgaccgccggtggtgcttcgacggggagcgcaacaaccaggtcctggaggagaacatggacgtggagatctggaccaaggagggcgagcggaagaagctccgcccccggtggctggacgcccgcacgtactccgacccgctggcgctccgggagttcaaggagttcgccgccgggcgccggagcgtgagcggcgacctgatcctggagatcggcaagctcccccagcacctgaccctgcgcgcccagaacgccctcgacaacctggtcatgctgcacaactccgagcagggcgggaaggcgtaccggcacgccatggaggagctccccgacaccatcgagaccctgatgctgctcgccctgatcgccgtgctgaccgggggcgtgaccctcttcttcctgagcgggaagggcctgggcaagacctccatcgggctcctgtgcgtcaccgcgagctccgccctgctctggatggccagcgtggagccccactggatcgccgcctccatcatcctggagttcttcctgatggtgctcctgatcccggagcccgaccgccagcggacgccccaggacaaccagctggcgtacgtcgtgatcggcctcctgttcatgatcctgaccgtggccgccaacgagatggggctcctggagaccaccaagcgcgacctgggcatcgggcacgtcgccgccgagaaccaccagcacgcgacgatgctcgacgtggacctgcggccggccagcgcctggaccctgtacgccgtggccaccaccgtcatcacgcccatgatgcgccacaccatcgagaacaccaccgcgaacatctccctcacggccatcgccaaccaggccgccatcctgatgggcctggacaagggctggcccatcagcaagatggacatcggggtgcccctcctggcgctgggctgctactcccaggtgaacccgctcaccctgaccgccgccgtcctgatgctcgtggcccactacgcgatcatcgggcccggcctgcaggccaaggccacccgcgaggcccagaagcggacggccgcggggatcatgaagaaccccaccgtggacggcatcgtcgccatcgacctggaccccgtggtgtacgacgccaagttcgagaagcagctcggccagatcatgctgctgatcctctgcaccagccagatcctgctgatgcgcaccacgtgggccctctgcgagtccatcaccctggccaccgggccgctgaccacgctctgggagggcagccccgggaagttctggaacaccaccatcgcggtctccatggccaacatcttccggggcagctacctggccggcgccgggctggccttctccctcatgaagtccctgggcgggggccgccgggggaccggcgcgcagggcgagacgctgggggagaagtggaagcgccagctcaaccagctgtccaagcccgagttcaacacctacaagcggagcggcatcatggaggtggaccgcagcgaggccaaggaggggctgaagcggggcgagaccaccaagcacgccgtgtcccgcgggaccgccaagctccggtggttcgtcgagcgcaacctggtgaagcccgagggcaaggtgatcgacctgggctgcgggcggggcgggtggagctactactgcgcgggcctgaagaaggtcacggaggtgaaggggtacaccaagggcggcccggggcacgaggagcccatccccatggccacctacggctggaacctcgtgaagctgcactccgggaaggacgtcttcttcatgcccccggagaagtgcgacaccctgctctgcgacatcggcgagagctcccccaaccccacgatcgaggaggggcgcaccctgcgggtgctgaagatggtggagccctggctccgcggcaaccagttctgcatcaagatcctgaacccgtacatgcccagcgtcgtggagaccctggagcagatgcagcggaagcacggcgggatgctcgtgcgcaaccccctgtcccggaacagcacccacgagatgtactgggtctcctgcggcacggggaacatcgtgagcgccgtgaacatgacctcccgcatgctgctcaaccgcttcaccatggcccaccggaagcccacctacgagcgcgacgtcgacctgggcgccggcacgcggcacgtggcggtggagccggaggtcgccaacctggacatcatcgggcagcgcatcgagaacatcaagaacgagcacaagagcacctggcactacgacgaggacaacccctacaagacctgggcctaccacggctcctacgaggtgaagcccagcgggtccgccagctccatggtgaacggcgtcgtgcggctcctgaccaagccctgggacgtcatcccgatggtgacgcagatcgccatgaccgacaccacccccttcgggcagcagcgcgtgttcaaggagaaggtcgacacgcggacgccccgggcgaagcggggcaccacccagatcatggaggtgacggccaagtggctgtggggcttcctcagccgcaacaagaagccgcggatctgcacccgcgaggagttcacccggaaggtgcgctccaacgccgccatcggggccgtcttcgtggacgagaaccagtggaacagcgcgaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggcagccgggcgatctggtacatgtggctgggcgcccgcttcctggagttcgaggccctcgggttcatgaacgaggaccactggttctcccgggagaacagcctgtccggcgtggagggggagggcctgcacaagctcgggtacatcctgcgcgacatcagcaagatccccggcggcaacatgtacgccgacgacacggccgggtgggacacccgcatcaccgaggacgacctgcagaacgaggcgaagatcaccgacatcatggagcccgagcacgccctcctggccacgtccatcttcaagctgacctaccagaacaaggtcgtgcgggtgcagcgccccgccaagaacggcaccgtcatggacgtgatcagccggcgcgaccagcgggggtccggccaggtgggcacctacgggctcaacacgttcaccaacatggaggtccagctgatccgccagatggagagcgagggcatcttcctgccgtccgagctcgagacccccaacctggccgagcgggtgctggactggctcgagaagcacggggcggagcgcctgaagcggatggccatcagcggcgacgactgcgtggtcaagcccatcgacgaccgcttcgccaccgccctgaccgccctcaacgacatggggaaggtgcggaaggacatcccccagtgggagccgtccaagggctggaacgactggcagcaggtccccttctgcagccaccacttccaccagctgatcatgaaggacggccgcgagatcgtcgtgccctgccggaaccaggacgagctggtggggcgcgcgcgggtctcccagggcgccgggtggagcctccgcgagacggcctgcctgggcaagtcctacgcccagatgtggcagctgatgtacttccaccggcgcgacctccggctggccgcgaacgccatctgcagcgccgtgcccgtggactgggtcccgacctcccgcaccacctggagcatccacgcccaccaccagtggatgacgaccgaggacatgctgagcgtgtggaaccgcgtgtggatcgaggagaacccctggatggaggacaagacccacgtctccagctgggaggaggtgccctacctcgggaagcgggaggaccagtggtgcggctccctgatcggcctgaccgcgcgcgccacgtgggccaccaacatccaggtggccatcaaccaggtccggcgcctcatcgggaacgagaactacctggactacatgaccagcatgaagcggttcaagaacgagtccgaccccgagggcgccctgtggtga

SEQ ID NO: 8138 - RNA, 9879 nt, synthetic construct
  misc_feature 1..9879: note = derived and/or modified CDS sequence (opt1) from DENV-1__JF937645__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccctcgtcgaccgcggctgggggaacggctgcgggctgttcggcaaggggagcctgctcacgtgcgccaagttcaagtgcgtgaccaagctggagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctcaccgactacggggccctgaccctggactgcagcccccggaccggcctcgacttcaacgagatggtgctgctgacgatgaaggagaagtcctggctcgtccacaagcagtggttcctggacctgccgctcccctggacctccggggccagcaccagccaggagacctggaaccgccaggacctgctggtgacgttcaagaccgcccacgcgaagaagcaggaggtggtcgtgctcggctcccaggagggcgccatgcacaccgccctgaccggggccacggagatccagaccagcggcaccaccacgatcttcgccgggcacctgaagtgccggctcaagatggacaagctgaccctgaagggcacctcctacgtgatgtgcaccgggagcttcaagctggagaaggaggtcgcggagacgcagcacggcaccgtgctcgtgcaggtcaagtacgagggcaccgacgccccctgcaagatccccttctccacccaggacgagaagggggtgacgcagaacggccgcctgatcaccgccaacccgatcgtgaccgacaaggagaagcccgtcaacatcgagaccgagccgcccttcggggagagctacatcgtggtgggcgccggcgagaaggcgctgaagctctcctggttcaagaaggggagctccatcggcaagatgttcgaggccacggcccgcggggcccgccggatggccatcctgggcgacaccgcgtgggacttcgggagcatcggcggcgtcttcacctccgtggggaagctggtgcaccaggtcttcggcaccgcctacggggtcctgttcagcggcgtgtcctggacgatgaagatcgggatcggcatcctgctgacctggctcggcctgaacagccgctccaccagcctgtccatgacctgcatcgccgtcgggatggtgacgctctacctgggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctcagcgcggccatcggcaaggcctgggaggagggggtgtgcggcatccgctccgccacccggctggagaacatcatgtggaagcagatcagcaacgagctgaaccacatcctcctggagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctcaagctgcgcgactcctacacccagatgtgcgaccaccggctgatgagcgcggccatcaaggactccaaggccgtccacgccgacatgggctactggatcgagagcgagaagaacgagacctggaagctcgcccgcgcgtccttcatcgaggtgaagacgtgcacctggcccaagagccacaccctgtggtccaacggcgtgctggagagcgagatgatcatccccaagatctacgggggcccgatctcccagcacaactaccggcccgggtacttcacccagacggccggcccctggcacctcgggaagctggagctggacttcgacctctgcgagggcaccaccgtcgtggtggacgagcactgcggcaaccgcgggccgagcctgcggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctggtgcgcagcatggtctccgccggcagcggcgaggtggacagcttctccctggggatcctctgcgccagcatcatgatcgaggaggtgatgcggtcccgctggagccggaagatgctgatgacgggcaccctggccgtcttcctcctgctgatcatggggcagctcacctggaacgacctgatccgcctgtgcatcatggtgggcgcgaacgcctccgaccgcatggggatgggcaccacgtacctcgccctgatggccaccttcaagatgcggccgatgttcgccgtgggcctcctcttccgccggctgaccagccgcgaggtcctgctcctgaccatcgggctgtccctcgtggcgagcgtggagctgcccaactccctggaggagctcggcgacgggctggccatgggcatcatgatgctgaagctcctgacggagttccagccccaccagctgtggaccaccctcctgagcctgaccttcatcaagacgaccctctccctggactacgcctggaagaccaccgccatggcgctgagcatcgtctccctcttccccctgtgcctgagcacgacctcccagaagaccacctggctcccggtgctgctgggcagcttcgggtgcaagcccctcaccatgttcctgatcacggagaacaagatctggggccggaagtcctggcccctgaacgaggggatcatggccatcggcatcgtcagcatcctcctgtccagcctgctcaagaacgacgtgcccctggccgggccgctgatcgccggcggcatgctcatcgcctgctacgtgatcagcgggtccagcgcggacctgtccctggagaaggccgccgaggtcagctgggagcaggaggccgagcactccggcaccagccacaacatcctcgtggaggtgcaggacgacgggaccatgaagatcaaggacgaggagcgcgacgacaccctgacgatcctgctcaaggccaccctgctggcggtctccggcgtgtaccccatgagcatccccgccaccctcttcgtgtggtacttctggcagaagaagaagcagcggtccggggtcctgtgggacacccccagcccgcccgaggtggagcgcgccgtgctggacgacggcatctaccggatcctgcagcgcggcctcctggggcggtcccaggtcggcgtgggggtgttccaggacggcgtcttccacacgatgtggcacgtgacccgcggggccgtgctgatgtaccagggcaagcggctcgagcccagctgggcctccgtcaagaaggacctgatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctctacgggaacggcgtggtcacgaccagcgggacctacgtgtccgccatcgcccaggcgaaggccagccaggagggccccctgcccgagatcgaggacgaggtgttcaagaagcgcaacctgaccatcatggacctccacccggggagcggcaagacgcggcgctacctgcccgccatcgtccgggaggccatcaagcgcaagctgcggaccctcatcctggcgcccacccgcgtggtggcctccgagatggccgaggccctgaagggcatgcccatccgctaccagaccacggccgtcaagagcgagcacaccgggcgggagatcgtggacctcatgtgccacgcgaccttcaccatgcgcctgctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctccgcaagaacggcaagcgggtcatccagctgagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctcaaggacggccccgagcgggtgatcctggcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctcctggacaacatcaacacccccgaggggatcatcccggccctgttcgagcccgagcgcgagaagtccgccgccatcgacggcgagtaccgcctccgcggggaggcccgcaagaccttcgtcgagctgatgcggcgcggcgacctgcccgtgtggctcagctacaaggtcgcgtccgagggcttccagtacagcgaccggcgctggtgcttcgacggggagcggaacaaccaggtgctggaggagaacatggacgtggagatctggaccaaggagggcgagcgcaagaagctgcggccccgctggctcgacgcccggacctactccgacccgctggccctgcgcgagttcaaggagttcgccgccgggcggcgcagcgtcagcggcgacctcatcctggagatcggcaagctgccccagcacctcacgctgcgggcgcagaacgccctggacaacctcgtgatgctgcacaactccgagcagggcgggaaggcctaccgccacgccatggaggagctgcccgacaccatcgagaccctcatgctgctggcgctcatcgccgtgctgaccgggggcgtcacgctgttcttcctcagcgggaagggcctgggcaagacctccatcgggctgctctgcgtgaccgccagctccgccctgctgtggatggccagcgtggagccccactggatcgcggcctccatcatcctcgagttcttcctgatggtcctgctcatcccggagcccgaccggcagcgcacgccccaggacaaccagctggcctacgtggtgatcggcctcctcttcatgatcctgacggtcgccgccaacgagatggggctgctcgagaccaccaagaaggacctgggcatcgggcacgtggcggccgagaaccaccagcacgccaccatgctggacgtggacctccggccggccagcgcctggacgctgtacgcggtcgccaccaccgtgatcacccccatgatgcgccacacgatcgagaacaccaccgccaacatctccctgaccgccatcgccaaccaggcggccatcctcatgggcctggacaagggctggcccatcagcaagatggacatcggggtgcccctgctcgccctgggctgctactcccaggtcaacccgctgacgctcaccgccgcggtgctgatgctggtggcccactacgccatcatcgggcccggcctccaggccaaggccacccgggaggcgcagaagcgcaccgccgccgggatcatgaagaaccccacggtcgacggcatcgtggccatcgacctggaccccgtggtctacgacgccaagttcgagaagcagctgggccagatcatgctcctgatcctgtgcaccagccagatcctcctgatgcgcaccacctgggcgctgtgcgagtccatcacgctcgccaccgggccgctgaccaccctgtgggagggcagccccgggaagttctggaacacgaccatcgccgtgtccatggccaacatcttccggggcagctacctcgccggcgcggggctggccttctccctgatgaagtccctcggcgggggccgccgggggaccggcgcccagggcgagaccctgggggagaagtggaagcgccagctgaaccagctctccaagagcgagttcaacacgtacaagcggagcggcatcatggaggtggaccgctccgaggccaaggaggggctgaagcggggcgagaccaccaagcacgcggtcagccgcgggaccgccaagctgcggtggttcgtggagcgcaacctggtgaagcccgagggcaaggtcatcgacctcggctgcgggcggggcgggtggtcctactactgcgccggcctgaagaaggtgaccgaggtgaaggggtacacgaagggcggccccgggcacgaggagccgatccccatggccacctacggctggaacctggtcaagctccacagcgggaaggacgtgttcttcatgccgcccgagaagtgcgacaccctgctgtgcgacatcggcgagtccagcccgaaccccaccatcgaggaggggcgcacgctccgggtgctgaagatggtcgagccctggctgcgcggcaaccagttctgcatcaagatcctcaacccctacatgccgtccgtggtggagaccctggagcagatgcagcggaagcacggcgggatgctggtccgcaaccccctcagccggaactccacccacgagatgtactgggtgagctgcggcaccgggaacatcgtgtccgccgtcaacatgacgagccgcatgctgctgaaccggttcaccatggcgcaccgcaagcccacctacgagcgcgacgtggacctcggcgccggcacccggcacgtggccgtcgagcccgaggtggccaacctggacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtcaacggcgtggtgcggctgctcaccaagccctgggacgtcatccccatggtgacccagatcgccatgacggacaccaccccgttcgggcagcagcgcgtcttcaaggagaaggtggacacccggacgccccgcgccaagcggggcaccacccagatcatggaggtgaccgccaagtggctgtggggcttcctgtcccgcaacaagaagccccggatctgcacgcgcgaggagttcacccggaaggtccgcagcaacgccgcgatcggggccgtgttcgtggacgagaaccagtggaacagcgccaaggaggccgtcgaggacgagcggttctgggacctcgtgcaccgcgagcgggagctgcacaagcagggcaagtgcgcgacctgcgtgtacaacatgatggggaagcgcgagaagaagctgggcgagttcgggaaggccaagggctcccgggccatctggtacatgtggctcggcgcccgcttcctggagttcgaggccctggggttcatgaacgaggaccactggttcagccgggagaactccctcagcggcgtcgagggggagggcctgcacaagctggggtacatcctccgcgacatctccaagatcccgggcggcaacatgtacgcggacgacaccgccgggtgggacacgcggatcaccgaggacgacctgcagaacgaggccaagatcaccgacatcatggagcccgagcacgccctgctcgccaccagcatcttcaagctgacgtaccagaacaaggtggtgcgcgtccagcgccccgcgaagaacggcaccgtgatggacgtgatctcccggcgcgaccagcgggggagcggccaggtcggcacctacgggctgaacaccttcacgaacatggaggtgcagctcatccgccagatggagtccgagggcatcttcctgcccagcgagctggagaccccgaacctcgccgagcgggtgctggactggctggagaagcacggggccgagcgcctcaagcggatggccatctccggcgacgactgcgtcgtgaagcccatcgacgaccgcttcgccaccgcgctgaccgccctgaacgacatggggaaggtgcggaaggacatcccccagtgggagcccagcaagggctggaacgactggcagcaggtcccgttctgctcccaccacttccaccagctcatcatgaaggacggccgcgagatcgtggtgccctgccggaaccaggacgagctggtcgggcgcgcccgggtgagccagggcgccgggtggtccctgcgcgagaccgcctgcctcggcaagagctacgcgcagatgtggcagctgatgtacttccaccggcgcgacctgcggctcgccgccaacgccatctgctccgcggtgcccgtcgactgggtgcccacgagccgcaccacctggagcatccacgcccaccaccagtggatgaccacggaggacatgctgtccgtgtggaaccgggtctggatcgaggagaacccgtggatggaggacaagacccacgtgagctcctgggaggaggtgccctacctggggaagcgcgaggaccagtggtgcggcagcctcatcggcctgaccgcccgcgccacctgggccacgaacatccaggtcgcgatcaaccaggtgcggcgcctgatcgggaacgagaactacctcgactacatgacctccatgaagcggttcaagaacgagagcgaccccgagggcgccctgtggtga

SEQ ID NO: 8139 - RNA, 9879 nt, synthetic construct
  misc_feature 1..9879: note = derived and/or modified CDS sequence (opt1) from DENV-1__FJ850114__SS-prME
  source 1..9879: mol_type = other RNA
agcgtgaccatgctgctcatgctgctgcccaccgccctcgccttccacctgacgacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccagccccgcgatcctccgcaagctgtgcatcgaggccaagatctccaacaccaccacggacagccggtgccccacccagggcgaggccaccctggtggaggagcaggacgccaacttcgtgtgccgccggaccttcgtcgaccgcggctgggggaacggctgcggcctcttcggcaaggggtccctgctgacgtgcgccaagttcaagtgcgtgaccaagctcgagggcaagatcgtgcagtacgagaacctgaagtacagcgtcatcgtgaccgtgcacaccggcgaccagcaccaggtcgggaacgagacgaccgagcacggcaccatcgcgaccatcacgccccaggcccccacgtccgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggaccagcggggccagcacctcccaggagacctggaaccgccaggacctcctggtgacgttcaagaccgcccacgcgaagaagcaggaggtggtcgtgctgggcagccaggagggcgccatgcacaccgccctcaccggggccacggagatccagacctccggcaccaccacgatcttcgccgggcacctgaagtgccggctgaagatggacaagctcaccctgaagggcaccagctacgtgatgtgcaccgggtccttcaagctggagaaggaggtcgcggagacgcagcacggcaccgtgctggtgcaggtcaagtacgagggcaccgacgccccctgcaagatccccttcagcacccaggacgagaagggggtgacgcagaacggccgcctcatcaccgccaacccgatcgtgaccgacaaggagaagcccgtcaacatcgagaccgagccgcccttcggggagtcctacatcgtggtgggcgccggcgagaaggcgctgaagctgagctggttcaagaaggggtccagcatcggcaagatgttcgaggccacggcccgcggggcccgccggatggccatcctcggcgacaccgcgtgggacttcgggtccatcggcggcgtcttcaccagcgtggggaagctggtgcaccaggtcttcggcaccgcctacggggtgctgttctccggcgtgagctggacgatgaagatcgggatcggcatcctcctgacctggctgggcctcaactcccgcagcacctccctgagcatgacctgcatcgccgtcgggatggtgacgctgtacctcggcgtgatggtccaggccgactccgggtgcgtgatcaactggaagggccgcgagctgaagtgcgggagcggcatcttcgtgaccaacgaggtccacacctggaccgagcagtacaagttccaggccgacagcccgaagcggctgtccgcggccatcggcaaggcctgggaggagggggtgtgcggcatccgcagcgccacccggctcgagaacatcatgtggaagcagatctccaacgagctgaaccacatcctgctcgagaacgacatgaagttcacggtggtcgtgggggacgccaacggcatcctggcgcaggggaagaagatgatccgcccccagcccatggagcacaagtacagctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgacagctacacccagatgtgcgaccaccggctgatgtccgcggccatcaaggacagcaaggccgtccacgccgacatgggctactggatcgagtccgagaagaacgagacctggaagctggcccgcgcgagcttcatcgaggtgaagacgtgcacctggcccaagtcccacaccctctggagcaacggcgtgctggagtccgagatgatcatccccaagacctacgggggcccgatcagccagcacaactaccggcccgggtacttcacgcagaccgccggcccctggcacctggggaagctcgagctggacttcgacctgtgcgagggcaccaccgtcgtggtggacgagcactgcggcaaccgcgggccgtccctccggacgaccaccgtcaccggcaagatcatccacgagtggtgctgccgcagctgcacgctgccgcccctgcggttccgcggggaggacggctgctggtacgggatggagatccggcccgtgaaggagaaggaggagaacctcgtgcgctccatggtcagcgccggcagcggcgaggtggactccttcagcctggggatcctgtgcgcctccatcatgatcgaggaggtgatgcggagccgctggtcccggaagatgctcatgaccggcaccctggccgtcttcctgctcctgatcatggggcagctgacctggaacgacctcatccgcctgtgcatcatggtgggcgcgaacgccagcgaccgcatggggatgggcacgacctacctggccctcatggccaccttcaagatgcggccgatgttcgccgtgggcctgctgttccgccggctcacctcccgcgaggtcctgctgctcacgatcgggctgagcctggtggcgtccgtggagctccccaacagcctggaggagctgggcgacgggctcgccatgggcatcatgatgctgaagctgctcaccgagttccagccccaccagctgtggaccaccctgctctccctgacgttcatcaagaccaccctgagcctcgactacgcctggaagaccacggccatggcgctgtccatcgtcagcctgttccccctctgcctgtccaccaccagccagaagaccacctggctgccggtgctcctgggctccttcgggtgcaagcccctgacgatgttcctcatcaccgagaacaagatctggggccgcaagagctggcccctgaacgaggggatcatggccatcggcatcgtctccatcctgctcagcagcctgctgaagaacgacgtgcccctcgccgggccgctgatcgccggcggcatgctgatcgcctgctacgtgatctccgggagctccgcggacctcagcctggagaaggccgccgaggtctcctgggagcaggaggccgagcacagcggcacctcccacaacatcctggtggaggtgcaggacgacgggaccatgaagatcaaggacgaggagcgcgacgacacgctcaccatcctgctgaaggccaccctcctggcggtcagcggcgtgtaccccatgtccatccccgccaccctgttcgtgtggtacttctggcagaagaagaagcagcggagcggggtcctctgggacacgccctccccgcccgaggtggagcgcgccgtgctggacgacggcatctaccggatcctgcagcgcggcctgctcgggcggagccaggtcggcgtgggggtgttccaggacggcgtcttccacaccatgtggcacgtgacccgcggggccgtgctgatgtaccagggcaagcggctggagccctcctgggccagcgtcaagaaggacctcatctcctacggcgggggctggcgcttccaggggagctggaacaccggcgaggaggtccaggtgatcgcggtcgagcccgggaagaacccgaagaacgtgcagacgacccccggcaccttcaagacccccgagggcgaggtgggggccatcgccctggacttcaagcccggcacgtccgggagcccgatcgtcaaccgggagggcaagatcgtgggcctgtacgggaacggcgtggtcaccacctccgggacctacgtgagcgccatcgcccaggcgaaggccagccaggagggccccctccccgagatcgaggacgaggtgttcaagaagcgcaacctgacgatcatggacctgcacccggggtccggcaagacccggcgctacctccccgccatcgtccgggaggccatcaagcgcaagctgcggaccctgatcctcgcgcccacccgcgtggtggccagcgagatggccgaggccctgaagggcatgcccatccgctaccagacgaccgccgtcaagtccgagcacaccgggcgggagatcgtggacctgatgtgccacgcgaccttcacgatgcgcctcctgagcccggtgcgggtccccaactacaacatgatcatcatggacgaggcccacttcaccgaccccgcctccatcgccgcccgcggctacatcagcacccgggtggggatgggcgaggcggccgccatcttcatgaccgccacgcccccggggtccgtggaggccttcccccagagcaacgcggtcatccaggacgaggagcgcgacatccccgagcggtcctggaacagcggctacgactggatcaccgacttccccggcaagaccgtgtggttcgtgccgtccatcaagagcgggaacgacatcgccaactgcctgcgcaagaacggcaagcgggtcatccagctctcccgcaagaccttcgacacggagtaccagaagaccaagaacaacgactgggactacgtggtgaccaccgacatcagcgagatgggggccaacttccgggccgaccgcgtcatcgacccccggcgctgcctgaagcccgtgatcctgaaggacggccccgagcgggtgatcctcgcggggccgatgcccgtcacggtggcctccgccgcccagcgccggggccgcatcggccggaaccagaacaaggagggggaccagtacgtgtacatgggccagcccctgaacaacgacgaggaccacgcccactggaccgaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgtcctacaaggtcgcgagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacgtacagcgacccgctcgccctgcgcgagttcaaggagttcgccgccgggcggcgcagcgtctccggcgacctgatcctcgagatcggcaagctgccccagcacctgaccctccgggcgcagaacgccctggacaacctggtgatgctccacaacagcgagcagggcgggaaggcctaccgccacgccatggaggagctgcccgacaccatcgagaccctgatgctcctggcgctgatcgccgtgctcaccggcggggtcaccctgttcttcctgtccgggaaggggctcggcaagaccagcatcgggctgctgtgcgtgaccgcctccagcgccctcctgtggatggcctccgtggagccccactggatcgcggccagcatcatcctggagttcttcctcatggtcctgctgatcccggagcccgaccggcagcgcacgccccaggacaaccagctcgcctacgtggtgatcggcctgctgttcatgatcctcaccgtcgccgccaacgagatggggctgctggagaccaccaagaaggacctcggcatcgggcacgtggcggccgagaaccaccagcacgccacgatgctggacgtggacctgcggccggcctccgcctggaccctctacgcggtcgccaccaccgtgatcacgcccatgatgcgccacaccatcgagaacaccaccgccaacatcagcctgacggccatcgccaaccaggcggccatcctgatgggcctcgacaagggctggcccatctccaagatggacatcggggtgcccctgctggccctcggctgctacagccaggtcaacccgctgaccctgaccgccgcggtgctcatgctggtggcccactacgccatcatcgggcccggcctgcaggccaaggccacccgggaggcgcagaagcgcacggccgccgggatcatgaagaaccccaccgtcgacggcatcgtggccatcgacctcgaccccgtggtctacgacgccaagttcgagaagcagctgggccagatcatgctgctcatcctgtgcacctcccagatcctgctcatgcgcaccacgtgggcgctgtgcgagagcatcaccctggccaccgggccgctcaccacgctgtgggagggctcccccgggaagttctggaacaccaccatcgccgtgagcatggccaacatcttccggggctcctacctggccggcgcggggctcgccttcagcctgatgaagtccctgggcgggggccgccgggggaccggcgcccagggcgagacgctcggggagaagtggaagcgccagctgaaccagctgagcaagagcgagttcaacacctacaagcggtccggcatcatggaggtggaccgcagcgaggccaaggaggggctcaagcggggcgagaccaccaagcacgcggtctcccgcgggaccgccaagctgcggtggttcgtggagcgcaacctggtgaagcccgagggcaaggtcatcgacctgggctgcgggcggggcgggtggagctactactgcgccggcctcaagaaggtgacggaggtgaaggggtacaccaagggcggccccgggcacgaggagccgatccccatggccacctacggctggaacctggtcaagctgcactccgggaaggacgtgttcttcatgccgcccgagaagtgcgacaccctcctgtgcgacatcggcgagagctccccgaaccccacgatcgaggaggggcgcaccctgcgggtgctcaagatggtcgagccctggctgcgcggcaaccagttctgcatcaagatcctgaacccctacatgccgagcgtggtggagatcctcgagcagatgcagcggaagcacggcgggatgctggtccgcaaccccctgtcccggaacagcacccacgagatgtactgggtgtcctgcggcaccgggaacatcgtgagcgccgtcaacatgacgtcccgcatgctcctgaaccggttcaccatggcgcaccgcaagcccacctacgagcgcgacgtggacctgggcgccggcacccggcacgtggccgtcgagcccgaggtggccaacctcgacatcatcgggcagcgcatcgagaacatcaagaacgagcacaagagcacgtggcactacgacgaggacaacccgtacaagacctgggcctaccacggctcctacgaggtgaagcccagcgggtccgcgagctccatggtcaacggcgtggtgcggctgctgaccaagccctgggacgtcatccccatggtgacccagatcgccatgacggacaccaccccgttcgggcagcagcgcgtcttcaaggagaaggtggacacccggacgccccgcgccaagcggggcaccacccagatcatggaggtgaccgccaagtggctctggggcttcctgagccgcaacaagaagccccggatctgcacgcgcgaggagttcacccggaaggtccgcagcaacgccgcgatcggggccgtgttcgtggacgagaaccagtggaactccgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatcccgggcggcaacatgtacgcggacgacaccgccgggtgggacacgcggatcaccgaggacgacctccagaacgaggccaagatcaccgacatcatggagcccgagcacgccctgctggccacctccatcttcaagctcacgtaccagaacaaggtggtgcgcgtccagcgccccgcgaagaacggcaccgtgatggacgtgatcagccggcgcgaccagcgggggtccggccaggtcggcacctacgggctgaacaccttcacgaacatggaggtgcagctgatccgccagatggagagcgagggcatcttcctcccctccgagctggagaccccgaacctggccgagcgggtgctcgactggctggagaagcacggggccgagcgcctgaagcggatggccatcagcggcgacgactgcgtcgtgaagcccatcgacgaccgcttcgccaccgcgctcaccgccctgaacgacatggggaaggtgcggaaggacatcccccagtgggagccctccaagggctggaacgactggcagcaggtcccgttctgcagccaccacttccaccagctgatcatgaaggacggccgcgagatcgtggtgccctgccggaaccaggacgagctcgtcgggcgcgcccgggtgtcccagggcgccgggtggagcctgcgcgagaccgcctgcctgggcaagtcctacgcgcagatgtggcagctcatgtacttccaccggcgcgacctgcggctggccgccaacgccatctgcagcgcggtgcccgtcgactgggtgcccacgagccgcaccacctggtccatccacgcccaccaccagtggatgaccacggaggacatgctcagcgtgtggaaccgggtctggatcgaggagaacccgtggatggaggacaagacccacgtgtccagctgggaggaggtgccctacctggggaagcgcgaggaccagtggtgcggctccctgatcggcctcaccgcccgcgccacctgggccacgaacatccaggtcgcgatcaaccaggtgcggcgcctgatcgggaacgagaactacctggactacatgatcagcatgaagcggttcaagaacgagtccgaccccgagggcgccctctggtga

SEQ ID NO: 8140 - RNA, 9879 nt, synthetic construct
  misc_feature 1..9879: note = derived and/or modified CDS sequence (opt1) from DENV-1__JN819402__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtgtccatgaccaacatcttccggggcagctacctggccggcgccgggctcgcgttctccctgatgaagtccctgggcgggggccgccgggggaccggcgcccagggcgagacgctcggggagaagtggaagcgccagctgaaccagctgtccaagagcgagttcaacacctacaagcggagcggcatcatggaggtggaccgctccgaggccaaggaggggctcaagcggggcgagaccaccaagcacgccgtcagccgcgggaccgcgaagctgcggtggttcgtggagcgcaacctggtgaagcccgagggcaaggtcatcgacctgggctgcgggcggggcgggtggtcctactactgcgccggcctcaagaaggtgacggaggtgaaggggtacaccaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccacgatcgaggaggggcgcaccctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacccacgagatgtactgggtgagctgcggcacggggaacatcgtgtccgccgtcaacatgaccagccgcatgctcctgaaccggttcaccatggcccaccgcaagcccacctacgagcgcgacgtggacctgggcgcgggcacgcggcacgtggccgtcgagcccgaggtggccaacctcgacatcatcgggcagcgcatcgagaacatcaagaacgagcacaagtccacctggcactacgacgaggacaacccgtacaagacctgggcctaccacggcagctacgaggtgaagccctccgggagcgcctccagcatggtcaacggcgtggtgcggctgctgaccaagccctgggacgtcatccccatggtgacgcagatcgcgatgaccgacaccaccccgttcgggcagcagcgcgtcttcaaggagaaggtggacacgcggacgccccgggccaagcggggcaccacccagatcatggaggtgacggccaagtggctctggggcttcctgtcccgcaacaagaagccccggatctgcacccgcgaggagttcacccggaaggtccgcagcaacgccgccatcggggcggtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggcgaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgccgacgacacggcggggtgggacacccggatcaccgaggacgacctccagaacgaggccaagatcaccgacatcatggagcccgagcacgccctgctggccacgagcatcttcaagctcacctaccagaacaaggtggtgcgcgtccagcgccccgccaagaacggcaccgtgatggacgtgatctcccggcgcgaccagcgggggagcggccaggtcggcacctacgggctgaacacgttcaccaacatggaggtgcagctgatccgcctcatggagtccgagggcatcttcctgcccagcgagctggagaccccgaacctcgcggagcgggtgctggactggctggagaagcacggggccgagcgcctcaagcggatggccatctccggcgacgactgcgtcgtgaagcccatcgacgaccgcttcgccaccgccctgaccgcgctgaacgacatggggaaggtgcggaaggacatcccccagtgggagcccagcaagggctggaacgactggcagcaggtcccgttctgctcccaccacttccaccagctcatcatgaaggacggccgcgagatcgtggtgccctgccggaaccaggacgagctggtcgggcgcgcccgggtgagccagggcgccgggtggtccctgcgcgagacggcctgcctcggcaagagctacgcccagatgtggcagctgatgtacttccaccggcgcgacctgcggctcgcggccaacgccatctgctccgccgtgcccgtcgactgggtgcccaccagccgcaccacctggagcatccacgcgcaccaccagtggatgacgaccgaggacatgctgtccgtgtggaaccgggtctggatcgaggagaacccgtggatggaggacaagacccacgtgagctcctgggaggaggtgccctacctggggaagcgcgaggaccagtggtgcggcagcctcatcggcctgaccgcccgcgccacgtgggccaccaacatccaggtcgccatcaaccaggtgcggcgcctgatcgggaacgagaactacctcgactacatgacctccatgaagcggttcaagagcgagtccgaccccgagggcgcgctgtggtga

SEQ ID NO: 8141 - RNA, 9879 nt, synthetic construct
  misc_feature 1..9879: note = derived and/or modified CDS sequence (opt1) from DENV-1__FJ850113__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggtcctgagcatcgtgtccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggcgatcggcatcgtgagcatcctgctctccagcctgctgaagaacgacgtgcccctcgccgggccgctgatcgccggcggcatgctgatcgcctgctacgtcatcagcgggtccagcgccgacctctccctggagaaggcggccgaggtgagctgggagcaggaggccgagcactccggcaccagccacaacatcctggtggaggtccaggacgacgggaccatgaagatcaaggacgaggagcgcgacgacaccctcacgatcctgctgaaggccaccctcctggccgtgtccggcgtgtaccccatgagcatccccgcgaccctgttcgtctggtacttctggcagaagaagaagcagcggtccggggtgctctgggacacccccagcccgcccgaggtggagcgcgccgtcctggacgacggcatctaccggatcctgcagcgcggcctgctcgggcggtcccaggtgggcgtgggggtcttccaggacggcgtgttccacacgatgtggcacgtgacccgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgccgtggagcccgggaagaacccgaagaacgtgcagaccacgcccggcaccttcaagacccccgagggcgaggtcggggcgatcgccctggacttcaagcccggcaccagcgggtccccgatcgtgaaccgggagggcaagatcgtgggcctgtacgggaacggcgtcgtgacgaccagcgggacctacgtgtccgccatcgcccaggccaaggcgagccaggagggccccctccccgagatcgaggacgaggtcttcaagaagcgcaacctgaccatcatggacctgcacccggggagcggcaagacgcggcgctacctccccgccatcgtgcgggaggccatcaagcgcaagctgcggaccctgatcctcgcccccacccgcgtggtcgcgtccgagatggccgaggccctgaagggcatgcccatccgctaccagaccacggccgtcaagagcgagcacaccgggcgggagatcgtggacctgatgtgccacgccaccttcaccatgcgcctcctgtccccggtccgggtgcccaactacaacatgatcatcatggacgaggcgcacttcacggaccccgccagcatcgccgcccgcggctacatctccacccgggtggggatgggcgaggccgcggccatcttcatgaccgccacgccgcccgggagcgtcgaggccttcccccagtccaacgccgtgatccaggacgaggagcgcgacatccccgagcggagctggaactccggctacgactggatcacggacttccccggcaagaccgtgtggttcgtccccagcatcaagtccgggaacgacatcgcgaactgcctgcgcaagaacggcaagcgggtgatccagctcagccgcaagaccttcgacaccgagtaccagaagacgaagaacaacgactgggactacgtggtcaccaccgacatctccgagatgggggccaacttccgggccgaccgcgtgatcgacccccggcgctgcctgaagcccgtgatcctgaaggacggccccgagcgggtcatcctcgccgggccgatgcccgtgaccgtggcgagcgccgcccagcgccggggccgcatcggccggaaccagaacaaggagggggaccagtacgtctacatgggccagcccctgaacaacgacgaggaccacgcccactggacggaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcctccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcgcggacctactccgacccgctcgccctgcgcgagttcaaggagttcgccgccgggcggcgcagcgtgagcggcgacctgatcctcgagatcggcaagctgccccagcacctgacgctccgggcccagaacgcgctggacaacctggtgatgctccacaactccgagcagggcgggaaggcctaccgccacgccatggaggagctgcccgacaccatcgagaccctgatgctcctggccctgatcgcggtcctcaccgggggcgtgacgctgttcttcctgagcgggaagggcctcggcaagacctccatcgggctgctgtgcgtgaccgccagctccgccctcctgtggatggccagcgtcgagccccactggatcgccgcgtccatcatcctggagttcttcctcatggtgctgctgatcccggagcccgaccggcagcgcacgccccaggacaaccagctcgcctacgtggtcatcggcctgctgttcatgatcctcacggtggccgccaacgagatggggctgctggagaccaccaagaaggacctcggcatcgggcacgtggccgcggagaaccaccagcacgccaccatgctggacgtcgacctgcggccggccagcgcctggacgctctacgccgtggcgaccaccgtgatcacccccatgatgcgccacacgatcgagaacaccaccgccaacatctccctgaccgccatcgccaaccaggccgcgatcctgatgggcctcgacaagggctggcccatcagcaagatggacatcggggtccccctgctggccctcggctgctactcccaggtgaacccgctgacgctgaccgccgccgtgctcatgctggtcgcgcactacgccatcatcgggcccggcctgcaggccaaggccacccgggaggcccagaagcgcaccgcggccgggatcatgaagaaccccacggtggacggcatcgtggccatcgacctcgaccccgtcgtgtacgacgccaagttcgagaagcagctgggccagatcatgctgctcatcctgtgcaccagccagatcctgctcatgcgcaccacctgggccctgtgcgagtccatcacgctggcgaccgggccgctcaccaccctgtgggagggcagccccgggaagttctggaacacgaccatcgccgtgtccatggccaacatcttccggggcagctacctggccggcgccgggctcgcgttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtcgaccgctccgaggccaaggaggggctcaagcggggcgagaccaccaagcacgccgtgagccgcgggaccgcgaagctgcggtggttcgtggagcgcaacctggtcaagcccgagggcaaggtgatcgacctgggctgcgggcggggcgggtggtcctactactgcgccggcctcaagaaggtgaccgaggtcaaggggtacacgaagggcggccccgggcacgaggagccgatccccatggccacctacggctggaacctggtgaagctgcacagcgggaaggacgtgttcttcatgccgcccgagaagtgcgacaccctcctgtgcgacatcggcgagtccagcccgaaccccaccatcgaggaggggcgcacgctgcgggtcctcaagatggtggagccctggctgcgcggcaaccagttctgcatcaagatcctgaacccctacatgccgtccgtggtcgagaccctcgagcagatgcagcggaagcacggcgggatgctggtgcgcaaccccctgagccggaactccacccacgagatgtactgggtgagctgcggcaccgggaacatcgtctccgccgtgaacatgacgagccgcatgctcctgaaccggttcaccatggcccaccgcaagcccacctacgagcgcgacgtggacctgggcgcgggcacccggcacgtcgccgtggagcccgaggtggccaacctcgacatcatcgggcagcgcatcgagaacatcaagaacgagcacaagtccacgtggcactacgacgaggacaacccgtacaagacctgggcctaccacggcagctacgaggtcaagccctccgggagcgcctccagcatggtgaacggcgtggtccggctgctgaccaagccctgggacgtgatccccatggtcacccagatcgcgatgacggacaccaccccgttcgggcagcagcgcgtgttcaaggagaaggtggacacccggacgccccgcgccaagcggggcaccacccagatcatggaggtcaccgccaagtggctctggggcttcctgtcccgcaacaagaagccccggatctgcacgcgcgaggagttcacccggaaggtgcgcagcaacgccgccatcggggcggtgttcgtcgacgagaaccagtggaacagcgccaaggaggccgtggaggacgagcggttctgggacctggtgcaccgcgagcgggagctccacaagcagggcaagtgcgcgacctgcgtctacaacatgatggggaagcgcgagaagaagctgggcgagttcgggaaggcgaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgccgacgacaccgcggggtgggacacgcggatcaccgaggacgacctccagaacgaggccaagatcaccgacatcatggagcccgagcacgccctgctggccaccagcatcttcaagctcacgtaccagaacaaggtggtccgcgtgcagcgccccgccaagaacggcaccgtgatggacgtcatctcccggcgcgaccagcgggggagcggccaggtgggcacctacgggctgaacaccttcacgaacatggaggtgcagctgatccgcctcatggagtccgagggcatcttcctgcccagcgagctggagaccccgaacctcgcggagcgggtcctggactggctggagaagcacggggccgagcgcctcaagcggatggccatctccggcgacgactgcgtggtgaagcccatcgacgaccgcttcgccaccgccctgaccgcgctgaacgacatggggaaggtccggaaggacatcccccagtgggagcccagcaagggctggaacgactggcagcaggtcccgttctgctcccaccacttccaccagctcatcatgaaggacggccgcgagatcgtggtcccctgccggaaccaggacgagctggtggggcgcgcccgggtgagccagggcgccgggtggtccctgcgcgagaccgcctgcctcggcaagagctacgcccagatgtggcagctgatgtacttccaccggcgcgacctgcggctcgcggccaacgccatctgctccgccgtccccgtggactgggtgcccacgagccgcaccacctggagcatccacgcgcaccaccagtggatgaccacggaggacatgctgtccgtctggaaccgggtgtggatcgaggagaacccgtggatggaggacaagacccacgtgagctcctgggaggaggtcccctacctggggaagcgcgaggaccagtggtgcggcagcctcatcggcctgaccgcccgcgccacctgggccacgaacatccaggtggccatcaaccaggtgcggcgcctgatcgggaacgagaactacctcgactacatgacctccatgaagcggttcaagagcgagtccgaccccgagggcgcgctgtggtga

SEQ ID NO: 8142 - RNA, 9879 nt, synthetic construct
  misc_feature 1..9879: note = derived and/or modified CDS sequence (opt1) from DENV-1__JF937635__SS-prME
  source 1..9879: mol_type = other RNA
agcgtgaccatgctgctcatgctgatgcccaccgccctggccttccacctcaccacccggggcggggagccccacatgatcgtgagcaagcacgagcggggcaaggcgctgctgttcaagaccagcaccggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggcaaccgcgacttcgtggaggggctctccggcgccacctgggtggacgtcgtgctggagcacgggagctgcgtgaccaccatggccaagaacaagcccacgctggacatcgagctcctgaagaccgaggtcaccaaccccgcggtgctgcggaagctctgcatcgaggccaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcctgacctgcgccaagttcaagtgcgtgaccaagctggagggcaagatcgtccagtacgagaacctcaagtacagcgtgatcgtgaccgtccacacgggcgaccagcaccaggtggggaacgagaccaccgagcacggcaccatcgcgaccatcacgccccaggcccccacctccgagatccagctgaccgactacggggccctgaccctcgactgcagcccccgcacgggcctggacttcaacgagatggtcctgctcaccatgaaggagaagtcctggctggtgcacaagcagtggttcctggacctcccgctgccctggaccagcggggcctccaccagccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcaccagctacgtcatgtgcacggggtccttcaagctggagaaggaggtggcggagacccagcacggcaccgtgctggtccaggtgaagtacgagggcaccgacgccccctgcaagatccccttcagcacgcaggacgagaagggggtgacccagaacggccggctgatcaccgccaacccgatcgtcaccgacaaggagaagcccgtgaacatcgagacggagccgcccttcggggagtcctacatcgtggtcggcgccggcgagaaggcgctcaagctgagctggttcaagaaggggtccagcatcggcaagatgttcgaggccaccgcccgcggggcccggcgcatggccatcctgggcgacaccgcgtgggacttcgggtccatcggcggcgtgttcaccagcgtggggaagctcgtccaccaggtgttcggcacggcctacggggtgctgttctccggcgtcagctggaccatgaagatcgggatcggcatcctgctcacctggctgggcctgaactcccgcagcacctccctcagcatgacgtgcatcgccgtggggatggtgaccctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgactccccgaagcgcctgagcgcggccatcggcaaggcctgggaggagggggtgtgcggcatccggagcgccacgcgcctggagaacatcatgtggaagcagatctccaacgagctcaaccacatcctgctggagaacgacatgaagttcaccgtcgtggtgggggacgccaacggcatcctcgcgcaggggaagaagatgatccggccccagcccatggagcacaagtacagctggaagtcctggggcaaggccaagatcatcggcgccgacatccagaacaccaccttcatcatcgacgggcccgacacgccggagtgccccgacgaccagcgcgcctggaacatctgggaggtcgaggactacggcttcgggatcttcaccaccaacatctggctgaagctgcgggacagctacacccagatgtgcgaccaccgcctcatgtccgcggccatcaaggacagcaaggccgtgcacgccgacatgggctactggatcgagtccgagaagaacgagacgtggaagctggcccgggcgagcttcatcgaggtgaagacctgcacctggcccaagtcccacaccctgtggagcaacggcgtcctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttccgcggggaggacggctgctggtacgggatggagatccgccccgtgaaggagaaggaggagaacctggtccggtccatggtgagcgccggctccggcgaggtggacagcttcagcctcgggatcctgtgcgtctccatcatgatcgaggaggtgatgcgcagccggtggtcccgcaagatgctgatgaccggcaccctcgccgtgttcctgctgctcatcatggggcagctgacctggaacgacctgatccgcctctgcatcatggtcggcgccaacgcgagcgaccggatggggatgggcacgacctacctggccctgatggccaccttcaagatgcgcccgatgttcgccgtgggcatcctcttccggcgcctgacctcccgggaggtgctgctcctgacgatcgggctgagcctcgtcgcctccgtggagctgcccaacagcctggaggagctcggcgacgggctggcgatgggcatcatgatgctgaagctcctgaccgagttccagccccaccagctgtggaccaccctcctgtccctgacgttcatcaagaccaccctcagcctggactacgcctggaagaccacggccatggccctgtccatcgtcagcctcttccccctgtgcctgtccaccaccagccagaagaccacctggctcccggtgctgctgggctccttcgggtgcaagcccctcacgatgttcctgatcaccgagaacaagatctggggccgcaagagctggcccatcaacgaggggatcatggcgatcggcatcgtgtccatcctgctcagctccctgctgaagaacgacgtccccctcgccgggccgctgatcgccggcggcatgctgatcgcctgctacgtgatcagcgggagctccgccgacctcagcctggagaaggcggccgaggtgtcctgggagcaggaggccgagcacagcggcacctcccacaacatcctggtcgaggtgcaggacgacgggaccatgcggatcaaggacgaggagaaggacgacacgctcaccatcctgctgaaggccaccctcctggccgtgagcggcgtctaccccatgtccatccccgcgaccctgttcgtgtggtacttctggcagaagaagaagcagcgcagcggggtgctctgggacacgccctccccgcccgaggtcgagcgggccgtgctggacgacggcatctaccgcatcctgcagcggggcctcctggggcgcagccaggtgggcgtcggggtgttccaggacggcgtgttccacaccatgtggcacgtcacccgcggggccgtgctgatgtaccagggcaagcgcctggagccctcctgggccagcgtgaagaaggacctcatctcctacggcgggggctggcggttccaggggagctggaacaccggcgaggaggtccaggtgatcgccgtggagcccgggaagaacccgaagaacgtccagacgacccccggcaccttcaagacctccgagggcgaggtgggggcgatcgccctggacttcaagcccggcacgagcgggtcccccatcgtgaaccgcgagggcaagatcgtcggcctgtacgggaacggcgtggtgaccaccagcgggacctacgtctccgccatcgcccaggccaagacgagccaggagggcccgccgcccgagatcgaggacgaggtgttcaagaagcggaacctcaccatcatggacctgcacccggggagcggcaagacccgccggtacctgcccgcgatcgtgcgcgaggccatcaagcggaagctccgcaccctgatcctggcccccacgcgcgtcgtggcctccgagatggcggaggccctcaagggcatgcccatccggtaccagaccaccgccgtcaagagcgagcacaccgggcgcgagatcgtcgacctgatgtgccacgccacgttcaccatgcggctgctctccccggtgcgcgtgcccaactacaacatgatcatcatggacgaggcccacttcaccgaccccgcgagcatcgccgcccggggctacatctccacccgcgtcgggatgggcgaggccgccgcgatcttcatgacggccacgccgcccgggagcgtggaggccttcccccagtccaacgccgtgatccaggacgaggagcgggacatccccgagcgcagctggaactccggctacgactggatcaccgacttccccggcaagaccgtctggttcgtgcccagcatcaagtccgggaacgacatcgccaactgcctgcggaagaacggcaagcgcgtgatccagctgagccggaagacgttcgacaccgagtaccagaagaccaagaacaacgactgggactacgtcgtgaccacggacatctccgagatgggggcgaacttccgcgccgaccgggtgatcgacccccgccggtgcctcaagcccgtcatcctgaaggacggccccgagcgcgtgatcctggccgggccgatgcccgtgaccgtcgccagcgcggcccagcggcgcggccggatcggccgcaaccagaacaaggagggggaccagtacgtgtacatgggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgcgcggggaggcccggaagaccttcgtcgagctgatgcgccggggcgacctccccgtgtggctgagctacaaggtggcctccgagggcttccagtacagcgaccgccggtggtgcttcgacggggagcgcaacaaccaggtcctggaggagaacatggacgtggagatctggacgaaggagggcgagcggaagaagctccgcccccggtggctggacgcccgcacctactccgacccgctggcgctccgggagttcaaggagttcgccgccgggcgccggagcgtgagcggcgacctgatcctggagatcggcaagctcccccagcacctgaccctgcgcgcccagaacgccctcgacaacctggtcatgctgcacaactccgagcagggcgggaaggcgtaccggcacgccatggaggagctccccgacaccatcgagacgctgatgctgctcgccctgatcgccgtgctgaccgggggcgtgaccctcttcttcctgagcgggaagggcctgggcaagacctccatcgggctcctgtgcgtcacggcgagctccgccctgctctggatggccagcgtggagccccactggatcgccgcctccatcatcctggagttcttcctgatggtgctcctgatcccggagcccgaccgccagcggacgccccaggacaaccagctggcgtacgtcgtgatcggcctcctgttcatgatcctgaccgtggccgccaacgagatggggctcctggagaccacgaagcgcgacctgggcatcgggcacgtcgccgccgagaaccaccagcacgcgaccatgctcgacgtggacctgcggccggccagcgcctggaccctgtacgccgtggccaccacggtcatcacccccatgatgcgccacaccatcgagaacaccacggcgaacatctccctcaccgccatcgccaaccaggccgccatcctgatgggcctggacaagggctggcccatcagcaagatggacatcggggtgcccctcctggcgctgggctgctactcccaggtgaacccgctcaccctgaccgccgccgtcctgatgctcgtggcccactacgcgatcatcgggcccggcctgcaggccaaggccacgcgcgaggcccagaagcggaccgccgcggggatcatgaagaaccccaccgtggacggcatcgtcgccatcgacctggaccccgtggtgtacgacgccaagttcgagaagcagctcggccagatcatgctgctgatcctctgcaccagccagatcctgctgatgcgcacgacctgggccctctgcgagtccatcaccctggccaccgggccgctgacgaccctctgggagggcagccccgggaagttctggaacaccaccatcgcggtctccatggccaacatcttccggggcagctacctggccggcgccgggctggccttctccctcatgaagtccctgggcgggggccgccgggggacgggcgcgcagggcgagaccctgggggagaagtggaagcgccagctcaaccagctgtccaagcccgagttcaacacctacaagcggagcggcatcatggaggtggaccgcagcgaggccaaggaggggctgaagcggggcgagaccaccaagcacgccgtgtcccgcgggacggccaagctccggtggttcgtcgagcgcaacctggtgaagcccgagggcaaggtgatcgacctgggctgcgggcggggcgggtggagctactactgcgcgggcctcaagaaggtcaccgaggtgaaggggtacaccaagggcggcccggggcacgaggagcccatccccatggccacctacggctggaacctggtgaagctgcactccgggaaggacgtcttcttcatgcccccggagaagtgcgacacgctgctctgcgacatcggcgagagctcccccaaccccaccatcgaggaggggcgcaccctgcgggtgctgaagatggtggagccctggctccgcggcaaccagttctgcatcaagatcctgaacccgtacatgcccagcgtcgtggagaccctggagcagatgcagcggaagcacggcgggatgctcgtgcgcaaccccctgtcccggaacagcacgcacgagatgtactgggtctcctgcggcaccgggaacatcgtgagcgccgtgaacatgacctcccgcatgctgctcaaccgcttcaccatggcccaccggaagcccacgtacgagcgcgacgtcgacctgggcgccggcacccggcacgtggcggtggagccggaggtcgccaacctggacatcatcgggcagcgcatcgagaacatcaagaacgagcacaagagcacctggcactacgacgaggacaacccctacaagacctgggcctaccacggctcctacgaggtgaagcccagcgggtccgccagctccatggtgaacggcgtcgtgcggctcctgacgaagccctgggacgtcatcccgatggtgacccagatcgccatgaccgacaccacgcccttcgggcagcagcgcgtgttcaaggagaaggtcgacacccggacgccccgggcgaagcggggcaccacgcagatcatggaggtgaccgccaagtggctgtggggcttcctcagccgcaacaagaagccgcggatctgcacccgcgaggagttcacccggaaggtgcgctccaacgccgccatcggggccgtcttcgtggacgagaaccagtggaacagcgcgaaggaggccgtggaggacgagcggttctgggacctggtccaccgcgagcgggagctgcacaagcagggcaagtgcgccacgtgcgtgtacaacatgatggggaagcgcgagaagaagctcggcgagttcgggaaggccaagggcagccgggcgatctggtacatgtggctgggcgcccgcttcctggagttcgaggccctcgggttcatgaacgaggaccactggttctcccgggagaacagcctgtccggcgtggagggggagggcctgcacaagctcgggtacatcctgcgcgacatcagcaagatccccggcggcaacatgtacgccgacgacaccgccgggtgggacacccgcatcaccgaggacgacctgcagaacgaggcgaagatcacggacatcatggagcccgagcacgccctcctggccacctccatcttcaagctgacctaccagaacaaggtcgtgcgggtgcagcgccccgccaagaacggcaccgtcatggacgtgatcagccggcgcgaccagcgggggtccggccaggtgggcacgtacgggctcaacaccttcaccaacatggaggtccagctgatccgccagatggagagcgagggcatcttcctgccgtccgagctcgagacccccaacctggccgagcgggtgctggactggctcgagaagcacggggcggagcgcctgaagcggatggccatcagcggcgacgactgcgtggtcaagcccatcgacgaccgcttcgccaccgccctgacggccctcaacgacatggggaaggtgcggaaggacatcccccagtgggagccgtccaagggctggaacgactggcagcaggtccccttctgcagccaccacttccaccagctgatcatgaaggacggccgcgagatcgtcgtgccctgccggaaccaggacgagctggtggggcgcgcgcgggtctcccagggcgccgggtggagcctccgcgagaccgcctgcctgggcaagtcctacgcccagatgtggcagctgatgtacttccaccggcgcgacctccggctggccgcgaacgccatctgcagcgccgtgcccgtggactgggtcccgacctcccgcaccacgtggagcatccacgcccaccaccagtggatgaccaccgaggacatgctgagcgtgtggaaccgcgtgtggatcgaggagaacccctggatggaggacaagacccacgtctccagctgggaggaggtgccctacctcgggaagcgggaggaccagtggtgcggctccctgatcggcctgacggcgcgcgccacctgggccaccaacatccaggtggccatcaaccaggtccggcgcctcatcgggaacgagaactacctggactacatgaccagcatgaagcggttcaagaacgagtccgaccccgagggcgccctgtggtga

SEQ ID NO: 8143 - RNA, 9879 nt, synthetic construct
  misc_feature 1..9879: note = derived and/or modified CDS sequence (opt1) from DENV-1__FJ024483__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtactacacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgcggtcagccgcgggaccgccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacacgaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccaccatcgaggaggggcgcacgctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacccacgagatgtactgggtgagctgcggcaccgggaacatcgtgtccgccgtcaacatgacgagccgcatgctcctgaaccggttcaccatggcgcaccgcaagcccacctacgagcgcgacgtggacctgggcgccggcacccggcacgtggccgtcgagcccgaggtggccaacctcgacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtcaacggcgtggtgcggctgctgaccaagccctgggacgtcatccccatggtgacccagatcgccatgacggacaccaccccgttcgggcagcagcgcgtcttcaaggagaaggtggacacccggacgccccgcgccaagcggggcaccacccagatcatggaggtgaccgccaagtggctctggggcttcctgtcccgcaacaagaagccccggatctgcacgcgcgaggagttcacccggaaggtccgcagcaacgccgcgatcggggccgtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccttcagcggcgtcgagggggagggcctgcacaagctcgggtacatcctgcgcgacatctccaagatcccgggcggcaacatgtacgcggacgacaccgccgggtgggacacgcggatcaccgaggacgacctgcagaacgaggccaagatcaccgacatcatggagcccgagcacgccctcctggccaccagcatcttcaagctgacgtaccagaacaaggtggtgcgcgtccagcgccccgcgaagaacggcaccgtgatggacgtgatctcccggcgcgaccagcgggggagcggccaggtcggcacctacgggctcaacaccttcacgaacatggaggtgcagctgatccgccagatggagtccgagggcatcttcctgcccagcgagctcgagaccccgaacctggccgagcgggtgctggactggctcgagaagcacggggccgagcgcctgaagcggatggccatctccggcgacgactgcgtcgtgaagcccatcgacgaccgcttcgccaccgcgctgaccgccctcaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctggtcgggcgcgcccgggtgagccagggcgccgggtggtccctccgcgagaccgcctgcctgggcaagagctacgcgcagatgtggcagctgatgtacttccaccggcgcgacctccggctggccgccaacgccatctgctccgcggtgcccgtcgactgggtgcccacgagccgcaccacctggagcatccacgcccaccaccagtggatgaccacggaggacatgctgtccgtgtggaaccgggtctggatcgaggagaacccgtggatggaggacaagacccacgtgagctcctgggaggaggtgccctacctcgggaagcgcgaggaccagtggtgcggcagcctgatcggcctgaccgcccgcgccacctgggccacgaacatccaggtcgcgatcaaccaggtgcggcgcctcatcgggaacgagaactacctggactacatgacctccatgaagcggttcaagaacgagagcgaccccgagggcgccctgtggtga

SEQ ID NO: 8144 - RNA, 9879 nt, synthetic construct
  misc_feature 1..9879: note = derived and/or modified CDS sequence (opt1) from DENV-1__EU596504__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcttcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgcggtcagccgcgggaccgccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacacgaagggcggccccgggcacgaggagccgatccccatggccacctacggctggaacctggtcaagctgtacagcgggaaggacgtgttcttcatgccgcccgagaagtgcgacaccctcctgtgcgacatcggcgagtccagcccgaaccccaccatcgaggaggggcgcacgctgcggatcctcaagatggtggagccctggctgcgcggcaaccagttctgcatcaagatcctgaacccctacatgccgtccgtcgtggagaccctcgagcagatgcagcggaagcacggcgggatgctggtgcgcaaccccctgagccggaactccacccacgagatgtactgggtcagctgcggcaccgggaacatcgtgtccgccgtgaacatgacgagccgcatgctcctgaaccggttcaccatggcgcaccgcaagcccacctacgagcgcgacgtcgacctgggcgccggcacccggcacgtggccgtggagcccgaggtcgccaacctcgacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtgaacggcgtcgtgcggctgctgaccaagccctgggacgtgatccccatggtcacccagatcgccatgacggacaccaccccgttcgggcagcagcgcgtgttcaaggagaaggtcgacacccggacgccccgcgccaagcggggcaccacccagatcatggaggtgaccgccaagtggctctggggcttcctgtcccgcaacaagaagccccggatctgcacgcgcgaggagttcacccggaaggtgcgcagcaacgccgcgatcggggccgtcttcgtggacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacaccgccgggtgggacacgcggatcaccgaggacgacctccagaacgaggccaagatcaccgacatcatggagcccgagcacgccctgctggccaccagcatcttcaagctcacgtaccagaacaaggtcgtgcgcgtgcagcgccccgcgaagaacggcaccgtcatggacgtgatctcccggcgcgaccagcgggggagcggccaggtgggcacctacgggctgaacaccttcacgaacatggaggtccagctgatccgccagatggagtccgagggcatcttcctccccagcgagctggagaccccgaacctggccgagcgggtgctcgactggctggagaagcacggggccgagcgcctgaagcggatggccatctccggcgacgactgcgtggtcaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctcgtggggcgcgcccgggtcagccagggcgccgggtggtccctgcgcgagaccgcctgcctgggcaagagctacgcgcagatgtggcagctcatgtacttccaccggcgcgacctgcggctggccgccaacgccatctgctccgcggtgcccgtggactgggtccccacgagccgcaccacctggagcatccacgcccaccaccagtggatgaccacggaggacatgctctccgtgtggaaccgggtgtggatcgaggagaacccgtggatggaggacaagacccacgtcagctcctgggaggaggtgccctacctggggaagcgcgaggaccagtggtgcggcagcctgatcggcctcaccgcccgcgccacctgggccacgaacatccaggtggcgatcaaccaggtccggcgcctgatcgggaacgagaactacctggactacatgacctccatgaagcggttcaagaacgagagcgaccccgagggcgccctctggtga

SEQ ID NO: 8145 - RNA, 9879 nt, synthetic construct
  misc_feature 1..9879: note = derived and/or modified CDS sequence (opt1) from DENV-1__FJ024481__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgcggtcagccgcgggaccgccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacacgaagggcggccccgggcacgaggagccgatccccatggccacctacggctggaacctggtcaagctgtacagcgggaaggacgtgttcttcatgccgcccgagaagtgcgacaccctcctgtgcgacatcggcgagtccagcccgaaccccaccatcgaggaggggcgcacgctgcggatcctcaagatggtggagccctggctgcgcggcaaccagttctgcatcaagatcctgaacccctacatgccgtccgtcgtggagaccctcgagcagatgcagcggaagcacggcgggatgctggtgcgcaaccccctgagccggaactccacccacgagatgtactgggtcagctgcggcaccgggaacatcgtgtccgccgtgaacatgacgagccgcatgctcctgaaccggttcaccatggcgcaccgcaagcccacctacgagcgcgacgtcgacctgggcgccggcacccggcacgtggccgtggagcccgaggtcgccaacctcgacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtgaacggcgtcgtgcggctgctgaccaagccctgggacgtgatccccatggtcacccagatcgccatgacggacaccaccccgttcgggcagcagcgcgtgttcaaggagaaggtcgacacccggacgccccgcgccaagcggggcaccacccagatcatggaggtgaccgccaagtggctctggggcttcctgtcccgcaacaagaagccccggatctgcacgcgcgaggagttcacccggaaggtgcgcagcaacgccgcgatcggggccgtcttcgtggacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacaccgccgggtgggacacgcggatcaccgaggacgacctccagaacgaggccaagatcaccgacatcatggagcccgagcacgccctgctggccaccagcatcttcaagctcacgtaccagaacaaggtcgtgcgcgtgcagcgccccgcgaagaacggcaccgtcatggacgtgatctcccggcgcgaccagcgggggagcggccaggtgggcacctacgggctgaacaccttcacgaacatggaggtccagctgatccgccagatggagtccgagggcatcttcctccccagcgagctggagaccccgaacctggccgagcgggtgctcgactggctggagaagcacggggccgagcgcctgaagcggatggccatctccggcgacgactgcgtggtcaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctcgtggggcgcgcccgggtcagccagggcgccgggtggtccctgcgcgagaccgcctgcctgggcaagagctacgcgcagatgtggcagctcatgtacttccaccggcgcgacctgcggctggccgccaacgccatctgctccgcggtgcccgtggactgggtccccacgagccgcaccacctggagcatccacgcccaccaccagtggatgaccacggaggacatgctctccgtgtggaaccgggtgtggatcgaggagaacccgtggatggaggacaagacccacgtcagctcctgggaggaggtgccctacctggggaagcgcgaggaccagtggtgcggcagcctgatcggcctcaccgcccgcgccacctgggccacgaacatccaggtggcgatcaaccaggtccggcgcctgatcgggaacgagaactacctggactacatgacctccatgaagcggttcaagaacgagagcgaccccgagggcgccctctggtga

SEQ ID NO: 8146 - RNA, 9879 nt, synthetic construct
  misc_feature 1..9879: note = derived and/or modified CDS sequence (opt1) from DENV-1__GQ199872__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgcggtcagccgcgggaccgccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacacgaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccaccatcgaggaggggcgcacgctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacccacgagatgtactgggtgagctgcggcaccgggaacatcgtgtccgccgtcaacatgacgagccgcatgctcctgaaccggttcaccatggcgcaccgcaagcccacctacgagcgcgacgtggacctgggcgccggcacccggcacgtggccgtcgagcccgaggtggccaacctcgacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtcaacggcgtggtgcggctgctgaccaagccctgggacgtcatccccatggtgacccagatcgccatgacggacaccaccccgttcgggcagcagcgcgtcttcaaggagaaggtggacacccggacgccccgcgccaagcggggcaccacccagatcatggaggtgaccgccaagtggctctggggcttcctgtcccgcaacaagaagccccggatctgcacgcgcgaggagttcacccggaaggtccgcagcaacgccgcgatcggggccgtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgcggacgacaccgccgggtgggacacgcggatcaccgaggacgacctccagaacgaggccaagatcaccgacatcatggagcccgagcacgccctgctggccaccagcatcttcaagctcacgtaccagaacaaggtggtgcgcgtccagcgccccgcgaagaacggcaccgtgatggacgtgatctcccggcgcgaccagcgggggagcggccaggtcggcacctacgggctgaacaccttcacgaacatggaggtgcagctgatccgccagatggagtccgagggcatcttcctccccagcgagctggagaccccgaacctggccgagcgggtgctcgactggctggagaagcacggggccgagcgcctgaagcggatggccatctccggcgacgactgcgtcgtgaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgctccgcggtgcccgtcgactgggtgcccacgagccgcaccacctggagcatccacgcccaccaccagtggatgaccacggaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcaccgcccgcgccacctgggccacgaacatccaggtcgcgatcaaccaggtgcggcgcctgatcgggaacgagaactacctggaccacatgacctccatgaagcggttcaagaacgagagcgaccccgagggcgccctctggtga

SEQ ID NO: 8147 - RNA, 9879 nt, synthetic construct
  misc_feature 1..9879: note = derived and/or modified CDS sequence (opt1) from DENV-1__FJ410290__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggggagctctgcgaggacaccatgacctacaagtgcccccagatcaccgaggccgagcccgacgacgtggactgctggtgcaacgccaccgacacctgggtcacctacgggacctgcagccagaccggggagcaccggcgggagaagcgctccgtggccctggcgccccacgtgggcctggggctcgagacgcggaccgagacctggatgagctccgagggcgcctggaagcagatccagcgggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccagccccgcgatcctccgcaagctgtgcatcgaggccaagatctccaacaccaccacggacagccggtgcccgacccagggcgaggccaccctggtggaggagcaggacgccaacttcgtgtgccgccggaccttcgtcgaccgcggctgggggaacggctgcggcctcttcggcaaggggtccctgctgacgtgcgccaagttcaagtgcgtgaccaagctcgagggcaagatcgtgcagtacgagaacctgaagtacagcgtcatcgtgaccgtgcacaccggcgaccagcaccaggtcgggaacgagacgaccgagcacggcaccatcgcgaccatcacgccccaggcccccacgtccgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggaccagcggggccagcacctcccaggagacctggaaccgccaggacctcctggtgacgttcaagaccgcccacgcgaagaagcaggaggtggtcgtgctgggcagccaggagggcgccatgcacaccgccctcaccggggccacggagatccagacctccggcaccaccacgatcttcgccgggcacctgaagtgccggctgaagatggacaagctcaccctgaagggcaccagctacgtgatgtgcaccgggtccttcaagctggagaaggaggtcgcggagacgcagcacggcaccgtgctggtgcaggtcaagtacgagggcaccgacgccccctgcaagatccccttcagcacccaggacgagaagggggtgacgcagaacggccgcctcatcaccgccaacccgatcgtgaccgacaaggagaagcccgtcaacatcgagaccgagccgcccttcggggagtcctacatcgtggtgggcgccggcgagaaggcgctgaagctgagctggttcaagaaggggtccagcatcggcaagatgttcgaggccacggcccgcggggcccgccggatggccatcctcggcgacaccgcgtgggacttcgggtccatcggcggcgtcttcaccagcgtggggaagctggtgcaccaggtcttcggcaccgcctacggggtgctgttctccggcgtgagctggacgatgaagatcgggatcggcatcctcctgacctggctgggcctcaactcccgcagcacctccctgagcatgacctgcatcgccgtcgggatggtgacgctgtacctcggcgtgatggtccaggccgactccgggtgcgtgatcaactggaagggccgcgagctgaagtgcgggagcggcatcttcgtgaccaacgaggtccacacctggaccgagcagtacaagttccaggccgacagcccgaagcggctgtccgcggccatcggcaaggcctgggaggagggggtgtgcggcatccgcagcgccacccggctcgagaacatcatgtggaagcagatctccaacgagctgaaccacatcctgctcgagaacgacatgaagttcacggtggtcgtgggggacgccaacggcatcctggcgcaggggaagaagatgatccgcccccagcccatggagcacaagtacagctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgacagctacacccagatgtgcgaccaccggctgatgtccgcggccatcaaggacagcaaggccgtccacgccgacatgggctactggatcgagtccgagaagaacgagacctggaagctggcccgcgcgagcttcatcgaggtgaagacgtgcacctggcccaagtcccacaccctctggagcaacggcgtgctggagtccgagatgatcatccccaagatctacgggggcccgatcagccagcacaactaccggcccgggtacttcacccagacggccggcccctggcacctggggaagctcgagctggacttcgacctgtgcgagggcaccaccgtcgtggtggacgagcactgcggcaaccgcgggccgtccctccggaccacgaccgtcaccggcaagatcatccacgagtggtgctgccgcagctgcaccctgccgcccctgcggttccgcggggaggacggctgctggtacgggatggagatccggcccgtgaaggagaaggaggagaacctcgtgcgctccatggtcagcgccggcagcggcgaggtggactccttcagcctggggatcctgtgcgtgtccatcatgatcgaggaggtcatgcggagccgctggtcccggaagatgctcatgacgggcaccctggtggtgttcctgctcctgatcatggggcagctgacctggaaggacctcatccgcctgtgcatcatggtcggcgccaacgccagcgaccgcatggggatgggcaccacgtacctggcgctcatggccaccttcaagatgcggccgatgttcgccgtgggcctgctgttccgccggctcacctcccgcgaggtgctgctgctcaccatcgggctgagcctggtcgcctccgtggagctccccaacagcctggaggagctgggcgacgggctcgccatgggcatcatgatgctgaagctgctcacggagttccagccccaccagctgtggaccaccctgctctccctgaccttcatcaagacgaccctgagcctcgactacgcgtggaagaccaccgccatggccctgtccatcgtcagcctgttccccctctgcctgtccacgaccagccagaagaccacctggctgccggtgctcctgggctccttcgggtgcaagcccctgaccatgttcctcatcacggagaacaagatctggggccgcaagagctggcccctgaacgaggggatcatggccatcggcatcgtgtccatcctgctcagcagcctgctgaagaacgacgtccccctcgcggggccgctgatcgccggcggcatgctgatcgcctgctacgtgatctccgggagctccgccgacctcagcctggagaaggccgcggaggtgtcctgggagcaggaggccgagcacagcggcacctcccacaacatcctggtcgaggtgcaggacgacgggaccatgaagatcaaggacgaggagcgcgacgacaccctcacgatcctgctgaaggccaccctcctggccgtgagcggcgtctaccccatgtccatccccgccaccctgttcgtgtggtacttctggcagaagaagaagcagcggagcggggtgctctgggacaccccctccccgcccgaggtcgagcgcgcggtgctggacgacggcatctaccggatcctgcagcgcggcctgctcgggcggagccaggtgggcgtcggggtgttccaggacggcgtgttccacacgatgtggcacgtcacccgcggggccgtgctgatgtaccagggcaagcggctggagccctcctgggccagcgtgaagaaggacctcatctcctacggcgggggctggcgcttccaggggagctggaacaccggcgaggaggtccaggtgatcgccgtggagcccgggaagaacccgaagaacgtccagaccacgcccggcaccttcaagacccccgagggcgaggtgggggccatcgcgctggacttcaagcccggcacctccgggagcccgatcgtgaaccgggagggcaagatcgtcggcctgtacgggaacggcgtggtgacgacctccgggacctacgtcagcgccatcgcccaggccaaggccagccaggagggccccctccccgagatcgaggacgaggtgttcaagaagcgcaacctgaccatcatggacctgcacccggggtccggcaagacgcggcgctacctccccgcgatcgtgcgggaggccatcaagcgcaagctgcggaccctgatcctcgcccccacccgcgtcgtggccagcgagatggcggaggccctgaagggcatgcccatccgctaccagaccacggccgtgaagtccgagcacaccgggcgggagatcgtcgacctgatgtgccacgccaccttcaccatgcgcctcctgagcccggtgcgggtgcccaactacaacatgatcatcatggacgaggcccacttcacggaccccgcgtccatcgccgcccgcggctacatcagcacccgggtcgggatgggcgaggccgccgcgatcttcatgaccgccacgccgcccgggtccgtggaggccttcccccagagcaacgccgtgatccaggacgaggagcgcgacatccccgagcggtcctggaacagcggctacgactggatcacggacttccccggcaagaccgtctggttcgtgccctccatcaagagcgggaacgacatcgccaactgcctgcgcaagaacggcaagcgggtgatccagctctcccgcaagaccttcgacaccgagtaccagaagacgaagaacaacgactgggactacgtcgtgaccaccgacatcagcgagatgggggcgaacttccgggccgaccgcgtgatcgacccccggcgctgcctgaagcccgtcatcctgaaggacggccccgagcgggtgatcctcgccgggccgatgcccgtgaccgtcgcctccgcggcccagcgccggggccgcatcggccggaaccagaacaaggagggggaccagtacgtgtacatgggccagcccctgaacaacgacgaggaccacgcccactggacggaggccaagatgctgctcgacaacatcaacacccccgaggggatcatcccggccctgttcgagcccgagcgcgagaagtccgcggccatcgacggcgagtaccgcctgcgcggggaggcccgcaagaccttcgtcgagctcatgcggcgcggcgacctgcccgtgtggctgtcctacaaggtggccagcgagggcttccagtactccgaccggcgctggtgcttcgacggggagcggaacaaccaggtcctcgaggagaacatggacgtggagatctggaccaaggagggcgagcgcaagaagctgcggccccgctggctggacgcccggacctacagcgacccgctcgcgctgcgcgagttcaaggagttcgccgccgggcggcgcagcgtgtccggcgacctgatcctcgagatcggcaagctgccccagcacctgacgctccgggcccagaacgccctggacaacctggtcatgctccacaacagcgagcagggcgggaaggcgtaccgccacgccatggaggagctgcccgacaccatcgagaccctgatgctcctggccctgatcgccgtgctcaccgggggcgtgacgctgttcttcctgtccgggaagggcctcggcaagaccagcatcgggctgctgtgcgtcaccgcgtccagcgccctcctgtggatggcctccgtggagccccactggatcgccgccagcatcatcctggagttcttcctcatggtgctgctgatcccggagcccgaccggcagcgcacgccccaggacaaccagctcgcgtacgtcgtgatcggcctgctgttcatgatcctcacggtggccgccaacgagatggggctgctggagaccaccaagaaggacctcggcatcgggcacgtcgccgccgagaaccaccagcacgcgaccatgctggacgtggacctgcggccggcctccgcctggacgctctacgccgtggccaccaccgtcatcacccccatgatgcgccacacgatcgagaacaccaccgcgaacatcagcctgaccgccatcgccaaccaggccgccatcctgatgggcctcgacaagggctggcccatctccaagatggacatcggggtgcccctgctggcgctcggctgctacagccaggtgaacccgctgacgctgaccgccgccgtcctcatgctggtggcccactacgcgatcatcgggcccggcctgcaggccaaggccacccgggaggcccagaagcgcaccgccgcggggatcatgaagaaccccacggtggacggcatcgtcgccatcgacctcgaccccgtggtgtacgacgccaagttcgagaagcagctgggccagatcatgctgctcatcctgtgcacctcccagatcctgctcatgcgcaccacctgggccctgtgcgagagcatcacgctggccaccgggccgctcaccaccctgtgggagggctcccccgggaagttctggaacacgaccatcgcggtcagcatggccaacatcttccggggctcctacctggccggcgccgggctcgccttcagcctgatgaagtccctgggcgggggccgccgggggaccggcgcgcagggcgagaccctcggggagaagtggaagcgccagctgaaccagctgagcaagagcgagttcaacacgtacaagcggtccggcatcatggaggtggaccgcttcgaggccaaggaggggctcaagcggggcgagaccaccaagcacgccgtgagccgcgggaccgccaagctgcggtggttcgtcgagcgcaacctggtgaagcccgagggcaaggtgatcgacctgggctgcgggcggggcgggtggtcctactactgcgcgggcctcaagaaggtcaccgaggtgaaggggtacacgaagggcggccccgggcacgaggagccgatccccatggccacctacggctggaacctggtgaagctgcacagcgggaaggacgtcttcttcatgccgcccgagaagtgcgacaccctcctgtgcgacatcggcgagtccagcccgaaccccaccatcgaggaggggcgcacgctgcgggtgctcaagatggtggagccctggctgcgcggcaaccagttctgcatcaagatcctgaacccctacatgccgtccgtcgtggagaccctcgagcagatgcagcggaagcacggcgggatgctggtgcgcaaccccctgagccggaactccacccacgagatgtactgggtcagctgcggcaccgggaacatcgtgtccgccgtgaacatgacgagccgcatgctcctgaaccggttcaccatggcccaccgcaagcccacctacgagcgcgacgtcgacctgggcgccggcacccggcacgtggcggtggagcccgaggtcgccaacctcgacatcatcgggcagcgcatcgagaacatcaagaacgagcacaagtccacgtggcactacgacgaggacaacccgtacaagacctgggcctaccacggcagctacgaggtgaagccctccgggagcgcctccagcatggtgaacggcgtcgtgaagctgctgaccaagccctgggacgtcatccccatggtgacccagatcgccatgacggacaccaccccgttcgggcagcagcgggtgttcaaggagaaggtcgacacccgcacgccccgggcgaagcgcggcaccacccagatcatggaggtgaccgccaagtggctctggggcttcctgtcccggaacaagaagccccgcatctgcacgcgggaggagttcacccgcaaggtgcggagcaacgccgccatcggggccgtcttcgtggacgagaaccagtggaacagcgcgaaggaggccgtggaggacgagcgcttctgggacctggtccaccgggagcgcgagctccacaagcagggcaagtgcgcgacctgcgtgtacaacatgatggggaagcgggagaagaagctgggcgagttcgggaaggccaagggctcccgcgcgatctggtacatgtggctgggcgcccggttcctcgagttcgaggccctggggttcatgaacgaggaccactggttcagccgcgagaactccctgagcggcgtggagggggagggcctccacaagctggggtacatcctgcgggacatctccaagatcccgggcggcaacatgtacgccgacgacaccgccgggtgggacacgcgcatcaccgaggacgacctccagaacgaggcgaagatcaccgacatcatggagcccgagcacgccctgctggccaccagcatcttcaagctcacgtaccagaacaaggtcgtgcgggtgcagcgccccgccaagaacggcaccgtcatggacgtgatctcccgccgggaccagcgcgggagcggccaggtgggcacctacgggctgaacaccttcacgaacatggaggtccagctgatccggcagatggagtccgagggcatcttcctccccagcgagctggagaccccgaacctggccgagcgcgtgctcgactggctggggaagcacggcgcggagcggctgaagcgcatggccatctccggggacgactgcgtggtcaagcccatcgacgaccggttcgccaccgccctcaccgccctgaacgacatgggcaaggtgcgcaaggacatcccccagtgggagcccagcaagggctggaacgactggcagcaggtcccgttctgctcccaccacttccaccagctgatcatgaaggacgggcgggagatcgtcgtgccctgccgcaaccaggacgagctcgtgggccgggcgcgcgtcagccagggggccggctggtccctgcgggagaccgcctgcctgggcaagagctacgcccagatgtggcagctcatgtacttccaccgccgggacctgcgcctggccacgaacgcgaagtgctccgccgtgcccgtggactgggtccccaccagccggaccacctggagcatccacgcccaccaccagtggatgacgaccgaggacatgctctccgtgtggaaccgcgtgtggatcgaggagaacccgtggatggaggacaagacccacgtcagctcctgggaggaggtgccctacctgggcaagcgggaggaccagtggtgcggcagcctgatcgggctcaccgcccgcgcgacgtgggccaccaacatccaggtggccatcaaccaggtccgccggctgatcggcaacgagaactacctggactacatgacctccatgcgccggttcaagaacgagagcgaccccgagggggccctctggtga

SEQ ID NO: 8148 - RNA, 9879 nt, synthetic construct
  misc_feature 1..9879: note = derived and/or modified CDS sequence (opt1) from DENV-1__FJ024423__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtggtggccttcttcctggcgcacgccatcggcaccagcatcacccagaaggggatcatcttcatcctcctgatgctggtcaccccctccatggccatgcgctgcgtgggcatcggcaaccgggacttcgtggaggggctcagcggcgccacgtgggtcgacgtggtgctggagcacgggtcctgcgtcaccaccatggccaagaacaagcccaccctggacatcgagctcctgaagacggaggtgaccaaccccgcgatcctgcgcaagctctgcatcgaggccaagatcagcaacaccaccacggactcccggtgcccgacccagggcgaggccaccctggtggaggagcaggacgccaacttcgtctgccgccggaccttcgtggaccgcggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgatcatcacgccccaggcccccaccagcgagatccagctgacggactacggggccctgaccctcgactgcagcccccggaccggcctggacttcaacgagatggtcctgctcaccatgaaggagaagtcctggctggtgcacaagcagtggttcctggacctcccgctgccctggacgtccggggccagcaccagccaggagacctggaaccgccaggacctgctcgtgaccttcaagacggcccacgcgaagaagcaggaggtcgtggtgctgggctcccaggagggcgccatgcacaccgccctgaccggggccaccgagatccagacgagcggcaccaccaccatcttcgccgggcacctcaagtgccggctgaagatggacaagctgacgctcaagggcacctcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctgatcacggccaacccgatcgtcaccgacaaggagaagcccgtgaacatcgagaccgagccgcccttcggggagagctacatcgtgatcggcgccggcgagaaggcgctcaagctgtcctggttcaagaaggggagctccatcggcaagatgttcgaggccaccgcccgcggggcccgccggatggccatcctgggcgacacggcgtgggacttcgggagcatcggcggcgtcttcacctccgtggggaagctcgtgcaccaggtcttcggcaccgcctacggggtgctgttcagcggcgtgtcctggaccatgaagatcgggatcggcatcctgctcacgtggctgggcctgaacagccgctccaccagcctctccatgacctgcatcgccgtcgggatggtgaccctgtacctgggcgtgatggtccaggccgacagcgggtgcgtgatcaactggaagggccgcgagctcaagtgcgggtccggcatcttcgtgacgaacgaggtccacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtggtcgtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacgaccagcgggcctggaacatctgggaggtggaggactacggcttcgggatcttcaccacgaacatctggctgaagctgcgcgactcctacacccagatgtgcgaccaccggctcatgagcgcggccatcaaggactccaaggccgtccacgccgacatgggctactggatcgagagcgagaagaacgagacctggaagctggcccgcgcgtccttcatcgaggtgaagacctgcacgtggcccaagagccacaccctgtggtccaacggcgtgctcgagagcgagatgatcatccccaagatctacgggggcccgatctcccagcacaactaccggcccgggtacttcacccagaccgccggcccctggcacctggggaagctggagctcgacttcgacctgtgcgagggcacgaccgtcgtggtggacgagcactgcggcaaccgcgggccgagcctgcggaccaccacggtcaccggcaagatcatccacgagtggtgctgccgctcctgcaccctgccgcccctgcggttccgcggggaggacggctgctggtacgggatggagatccggcccgtgaaggagaaggaggagaacctggtgcgcagcatggtctccgccggcagcggcgaggtggacagcttctccctcgggatcctgtgcgccagcatcatgatcgaggaggtgatgcggtcccgctggagccggaagatgctgatgaccggcacgctcgccgtcttcctgctgctcatcatggggcagctgacctggaacgacctgatccgcctctgcatcatggtgggcgcgaacgcctccgaccgcatggggatgggcaccacctacctggccctgatggccacgttcaagatgcggccgatgttcgccgtgggcctcctgttccgccggctgaccagccgcgaggtcctcctgctgaccatcgggctctccctggtggcgagcgtggagctgcccaactccctcgaggagctgggcgacgggctggccatgggcatcatgatgctcaagctgctgaccgagttccagccccaccagctctggacgaccctgctgagcctcaccttcatcaagaccacgctgtccctggactacgcctggaagaccaccgccatggcgctcagcatcgtctccctgttccccctgtgcctcagcaccacgtcccagaagaccacctggctgccggtgctgctcggcagcttcgggtgcaagcccctgaccatgttcctgatcaccgagaacaagatctggggccggaagtcctggcccctcaacgaggggatcatggccatcggcatcgtcagcatcctgctgtccagcctcctgaagaacgacgtgcccctggccgggccgctcatcgccggcggcatgctgatcgcctgctacgtgatcagcgggtccagcgcggacctgtccctcgagaaggccgccgaggtcagctgggagcaggaggccgagcactccggcacgagccacaacatcctggtggaggtgcaggacgacgggaccatgaagatcaaggacgaggagaaggacgacaccctgaccatcctcctgaaggccacgctgctcgcggtctccggcgtgtaccccatgagcatccccgccaccctgttcgtgtggtacttctggcagaagaagaagcagcgctccggggtcctgtgggacacccccagcccgcccgaggtggagcgggccgtgctcgacgacggcatctaccgcatcctgcagcggggcctgctggggcgctcccaggtcggcgtgggggtgttccaggacggcgtcttccacaccatgtggcacgtgacgcgcggggccgtgctcatgtaccagggcaagcgcctggagcccagctgggcctccgtcaagaaggacctgatcagctacggcgggggctggcggttccaggggtcctggaacaccggcgaggaggtccaggtgatcgcggtcgagcccgggaagaacccgaagaacgtgcagaccacccccggcacgttcaagacccccgagggcgaggtgggggccatcgccctcgacttcaagcccggcaccagcgggtccccgatcgtcaaccgcgagggcaagatcgtgggcctgtacgggaacggcgtggtcaccacgagcgggacctacgtgtccgccatcgcccaggcgaaggccagccaggagggccccctgcccgagatcgaggacgaggtgttcaagaagcggaacctcaccatcatggacctgcacccggggagcggcaagacccgccggtacctgcccgccatcgtccgcgaggccatcaagcggaagctccgcacgctgatcctggcgcccacccgggtggtggcctccgagatggccgaggccctcaagggcatgcccatccgctaccagaccaccgccgtcaagagcgagcacacggggcgcgagatcgtggacctgatgtgccacgcgaccttcaccatgcggctgctctccccggtgcgcgtccccaactacaacatgatcatcatggacgaggcccacttcaccgaccccgccagcatcgccgcccggggctacatctccacgcgcgtggggatgggcgaggcggccgccatcttcatgaccgccacgccgcccgggagcgtggaggccttcccccagtccaacgcggtcatccaggacgaggagcgggacatccccgagcgcagctggaactccggctacgactggatcaccgacttccccggcaagacggtgtggttcgtgcccagcatcaagtccgggaacgacatcgccaactgcctgcggaagaacggcaagcgcgtcatccagctgagccggaagaccttcgacaccgagtaccagaagaccaagaacaacgactgggactacgtggtgacgaccgacatctccgagatgggggccaacttccgcgccgaccgggtcatcgacccccgccggtgcctcaagcccgtgatcctgaaggacggccccgagcgcgtgatcctggcggggccgatgcccgtcaccgtggccagcgccgcccagcggcgcggccggatcggccgcaaccagaacaaggagggggaccagtacgtgtacatgggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgcgcggggaggcccggaagaccttcgtcgagctgatgcgccggggcgacctccccgtgtggctgagctacaaggtcgcgtccgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacctactccgacccgctggccctccgggagttcaaggagttcgccgccgggcgccggagcgtcagcggcgacctgatcctggagatcggcaagctcccccagcacctgaccctgcgcgcgcagaacgccctcgacaacctggtgatgctgcacaactccgagcagggcgggaaggcctaccggcacgccatggaggagctccccgacacgatcgagaccctgatgctgctcgcgctgatcgccgtgctgaccgggggcgtcaccctcttcttcctgagcgggaagggcctgggcaagacgtccatcgggctcctgtgcgtgaccgccagctccgccctgctctggatggccagcgtggagccccactggatcgcggcctccatcatcctggagttcttcctgatggtcctcctgatcccggagcccgaccgccagcggacgccccaggacaaccagctggcctacgtggtgatcggcctcctgttcatgatcctgaccgtcgccgccaacgagatggggctcctggagacgaccaagaaggacctgggcatcgggcacgtggcggccgagaaccaccagcacgccaccatgctcgacgtggacctgcgcccggccagcgcctggaccctgtacgcggtcgccacgaccgtgatcacccccatgatgcggcacaccatcgagaacacgaccgccaacatctccctcaccgccatcgccaaccaggcggccatcctgatgggcctggacaagggctggcccatcagcaagatggacatcggggtgcccctcctggccctgggctgctactcccaggtcaacccgctcaccctgacggccgcggtgctgatgctcgtggcccactacgccatcatcgggcccggcctgcaggccaaggccacccgcgaggcgcagaagcggaccgccgccgggatcatgaagaaccccaccgtcgacggcatcgtggccatcgacctggaccccgtggtctacgacgccaagttcgagaagcagctcggccagatcatgctgctgatcctctgcacgagccagatcctgctgatgcgcaccacctgggcgctctgcgagtccatcaccctggccacggggccgctgaccaccctctgggagggcagccccgggaagttctggaacaccacgatcgccgtgtccatggccaacatcttccgcggcagctacctggccggcgcggggctggccttctccctcatgaagtccctgggcgggggccggcgcgggaccggcgcccagggcgagaccctgggggagaagtggaagcggcagctcaaccagctgtccaagagcgagttcaacacctacaagcgcagcggcatcatggaggtggaccggtccgaggccaaggaggggctgaagcgcggcgagacgaccaagcacgcggtcagccgggggaccgccaagctccgctggttcgtggagcggaacctggtgaagcccgagggcaaggtcatcgacctgggctgcgggcgcggcgggtggtcctactactgcgccggcctgaagaaggtgaccgaggtgaaggggtacaccaagggcggccccgggcacgaggagccgatccccatggccacgtacggctggaacctcgtcaagctgcacagcgggaaggacgtgttcttcatgccgcccgagaagtgcgacaccctgctctgcgacatcggcgagtccagcccgaaccccaccatcgaggaggggcggaccctgcgcgtgctgaagatggtcgagccctggctccggggcaaccagttctgcatcaagatcctgaacccctacatgccgtccgtggtggagacgctggagcagatgcagcgcaagcacggcgggatgctcgtccggaaccccctgagccgcaactccacccacgagatgtactgggtgagctgcggcaccgggaacatcgtgtccgccgtcaacatgaccagccggatgctgctcaaccgcttcacgatggcgcaccggaagcccacctacgagcgcgacgtggacctgggcgccggcacccgccacgtggccgtcgagcccgaggtggccaacctggacatcatcgggcagcggatcgagaacatcaagaacgagcacaagtccacctggcactacgacgaggacaacccgtacaagacgtgggcctaccacggcagctacgaggtgaagccctccgggagcgcgtccagcatggtcaacggcgtggtgcgcctcctgaccaagccctgggacgtcatccccatggtgacccagatcgccatgaccgacacgaccccgttcgggcagcagcgggtcttcaaggagaaggtggacacccgcacgccccgggccaagcgcggcacgacccagatcatggaggtgaccgccaagtggctgtggggcttcctctcccggaacaagaagccccgcatctgcacccgggaggagttcacgcgcaaggtccggagcaacgccgcgatcggggccgtgttcgtggacgagaaccagtggaacagcgccaaggaggccgtcgaggacgagcgcttctgggacctggtgcaccgggagcgcgagctgcacaagcagggcaagtgcgcgacctgcgtgtacaacatgatggggaagcgggagaagaagctcggcgagttcgggaaggccaagggctcccgcgccatctggtacatgtggctgggcgcccggttcctggagttcgaggccctcgggttcatgaacgaggaccactggttcagccgcgagaactccctgagcggcgtcgagggggagggcctgcacaagctcgggtacatcctgcgggacatctccaagatcccgggcggcaacatgtacgcggacgacaccgccgggtgggacacccgcatcacggaggacgacctgcagaacgaggccaagatcaccgacatcatggagcccgagcacgccctcctggccaccagcatcttcaagctgacctaccagaacaaggtggtgcgggtccagcgccccgcgaagaacggcacggtgatggacgtgatctcccgccgggaccagcgcgggagcggccaggtcggcacctacgggctcaacaccttcaccaacatggaggtgcagctgatccggcagatggagtccgagggcatcttcctgcccagcgagctcgagacgccgaacctggccaagcgcgtgctggactggctcgagaagcacggggccgagcggctgaagcgcatggccatctccggcgacgactgcgtcgtgaagcccatcgacgaccggttcgccaccgcgctgaccgccctcaacgacatggggaaggtgcgcaaggacatcccccagtgggagcccagcaagggctggaacgactggcagcaggtcccgttctgctcccaccacttccaccagctgatcatgaaggacggccgggagatcgtggtgccctgccgcaaccaggacgagctggtcgggcgggcccgcgtgagccagggcgccgggtggtccctccgggagaccgcctgcctgggcaagagctacgcgcagatgtggcagctgatgtacttccaccgccgggacctccgcctggccgccaacgccatctgctccgcggtgcccgtcgactgggtgcccaccagccggacgacctggagcatccacgcccaccaccagtggatgaccaccgaggacatgctgtccgtgtggaaccgcgtctggatcgaggagaacccgtggatggaggacaagacgcacgtgagctcctgggaggaggtgccctacctcgggaagcgggaggaccagtggtgcggcagcctgatcggcctgaccgcccgcgccacctgggccaccaacatccaggtcgcgatcaaccaggtgcgccggctcatcgggaacgagaactacctggactacatgacgtccatgaagcgcttcaagaacgagagcgaccccgagggcgccctgtggtga

SEQ ID NO: 8149 - RNA, 9879 nt, synthetic construct
  misc_feature 1..9879: note = derived and/or modified CDS sequence (opt1) from DENV-1__FJ547089__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagaccatccacgagtggtgctgccgctcctgcacgctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgaccggcaccctggccgtcttcctgctcctgatcatggggcagctgacctggaacgacctcatccgcctgtgcatcatggtgggcgcgaacgcctccgaccgcatggggatgggcacgacctacctggccctcatggccaccttcaagatgcggccgatgttcgccgtgggcctgctgttccgccggctcaccagccgcgaggtcctgctgctcacgatcgggctgtccctggtggcgagcgtggagctccccaactccctggaggagctgggcgacgggctcgccatgggcatcatgatgctgaagctgctcaccgagttccagccccaccagctgtggaccaccctgctcagcctgacgttcatcaagaccaccctgtccctcgactacgcctggaagaccacggccatggcgctgagcatcgtctccctgttccccctctgcctgagcaccacctcccagaagaccacctggctgccggtgctcctgggcagcttcgggtgcaagcccctgacgatgttcctcatcaccgagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacacgctcaccatcctgctgaaggccaccctcctggcggtctccggcgtgtaccccatgagcatccccgccaccctgttcgtgtggtacttctggcagaagaagaagcagcggtccggggtcctctgggacacgcccagcccgcccgaggtggagcgcgccgtgctggacgacggcatctaccggatcctgcagcgcggcctgctcgggcggtcccaggtcggcgtgggggtgttccaggacggcgtcttccacaccatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagacgacccccggcaccttcaagacccccgagggcgaggtgggggccatcgccctggacttcaagcccggcacgagcgggtccccgatcgtcaaccgggagggcaagatcgtgggcctgtacgggaacggcgtggtcaccaccagcgggacctacgtgtccgccatcgcccaggcgaaggccagccaggagggccccctccccgagatcgaggacgaggtgttcaagaagcgcaacctgacgatcatggacctgcacccggggagcggcaagacccggcgctacctccccgccatcgtccgggaggccatcaagcgcaagctgcggaccctgatcctcgcgcccacccgcgtggtggcctccgagatggccgaggccctgaagggcatgcccatccgctaccagacgaccgccgtcaagagcgagcacaccgggcgggagatcgtggacctgatgtgccacgcgaccttcacgatgcgcctcctgtccccggtgcgggtccccaactacaacatgatcatcatggacgaggcccacttcaccgaccccgccagcatcgccgcccgcggctacatctccacccgggtggggatgggcgaggcggccgccatcttcatgaccgccacgcccccggggagcgtggaggccttcccccagtccaacgcggtcatccaggacgaggagcgcgacatccccgagcggagctggaactccggctacgactggatcaccgacttccccggcaagaccgtgtggttcgtgccgagcatcaagtccgggaacgacatcgccaactgcctgcgcaagaacggcaagcgggtcatccagctcagccgcaagaccttcgacacggagtaccagaagaccaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcacggtggccagcgccgcccagcgccggggccgcatcggccggaaccagaacaaggagggggaccagtacgtgtacatgggccagcccctgaacaacgacgaggaccacgcccactggaccgaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacgtactccgacccgctcgccctgcgcgagttcaaggagttcgccgccgggcggcgcagcgtcagcggcgacctgatcctcgagatcggcaagctgccccagcacctgaccctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccggcggggtcaccctgttcttcctgagcgggaaggggctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcaccgtcgccgccaacgagatggggctgctggagaccaccaagaaggacctcggcatcgggcacgtggcggccgagaaccaccagcacgccacgatgctggacgtggacctgcggccggccagcgcctggaccctctacgcggtcgccaccaccgtgatcacgcccatgatgcgccacaccatcgagaacaccaccgccaacatctccctgacggccatcgccaaccaggcggccatcctgatgggcctcgacaagggctggcccatcagcaagatggacatcggggtgcccctgctggccctcggctgctactcccaggtcaacccgctgaccctgaccgccgcggtgctcatgctggtggcccactacgccatcatcgggcccggcctgcaggccaaggccacccgggaggcgcagaagcgcacggccgccgggatcatgaagaaccccaccgtcgacggcatcgtggccatcgacctcgaccccgtggtctacgacgccaagttcgagaagcagctgggccagatcatgctgctcatcctgtgcaccagccagatcctgctcatgcgcaccacgtgggcgctgtgcgagtccatcaccctggccaccgggccgctcaccacgctgtgggagggcagccccgggaagttctggaacaccaccatcgccgtgtccatggccaacatcttccggggcagctacctggccggcgcggggctcgccttctccctgatgaagtccctgggcgggggccgccgggggaccggcgcccagggcgagacgctcggggagaagtggaagcgccagctgaaccagctgtccaagagcgagttcaacacctacaagcggagcggcatcatggaggtggaccgctccgaggccaaggaggggctcaagcggggcgagaccaccaagcacgcggtcagccgcgggaccgccaagctgcggtggttcgtggagcgcaacctggtgaagcccgagggcaaggtcatcgacctgggctgcgggcggggcgggtggtcctactactgcgccggcctcaagaaggtgacggaggtgaaggggtacaccaagggcgtccccgcccgcgaggagccgatccccatggccacctacggctggaacctggtgaagctgcacagcgggaaggacgtgttcttcatgccgcccgagaagtgcgacaccctcctgtgcgacatcggcgagtccagcccgaaccccacgatcgaggaggggcggaccctgcgcgtcctcaagatggtggagccctggctgcggggcaaccagttctgcatcaagatcctgaacccctacatgccgtccgtggtcgagaccctcgagcagatgcagcgcaagcacgggggcatgctggtgcggaaccccctgagccgcaactccacccacgagatgtactgggtgagctgcggcacggggaacatcgtctccgcggtgaacatgaccagccggatgctcctgaaccgcttcaccatggcccaccgcaagcccacctacgagcgggacgtggacctgggcgccgggacgcgccacgtcgccgtggagcccgaggtggccaacctcgacatcatcggccagcggatcgagaacatcaagaacgagcacaagtccacctggcactacgacgaggacaacccgtacaagacctgggcgtaccacggcagctacgaggtcaagccctccgggagcgcctccagcatggtgaacggcgtggtccgcctgctgaccaagccctgggacgtgatccccatggtcacgcagatcgccatgaccgacaccaccccgttcgggcagcagcgggtgttcaaggagaaggtggacacgcgcacgccccgggccaagcgcggcaccacccagatcatggaggtcacggccaagtggctctgggggttcctgtcccggaacaagaagccccgcatctgcacccgggaggagttcacccgcaaggtgcggagcaacgcggccatcggcgccgtgttcatcgacgagaaccagtggaacagcgccaaggaggcggtcgaggacgagcgcttctgggacctggtgcaccgggagcgcgagctccacaagcagggcaagtgcgcgacctgcgtgtacaacatgatggggaagcgggagaagaagctgggcgagttcgggaaggccaagggctcccgcgccatctggtacatgtggctgggggcccggttcctcgagttcgaggcgctgggcttcatgaacgaggaccactggttcagccgcgagaactccctgagcggcgtcgagggggagggcctccacaagctggggtacatcctgcgggacatctccaagatcccgggcgggaacatgtacgccgacgacacggccggctgggacacccgcgtgaccgaggacgacctccagaacgaggccaagatcaccgacatcatggagcccgagcacgccctgctggcgacgagcatcttcaagctcacctaccagaacaaggtggtccgcgtgcagcggcccgccaagaacggcaccgtgatggacgtcatctcccgccgggaccagcgcgggagcggccaggtggggacctacggcctgaacacgttcaccaacatggaggtgcagctgatccggcagatggagtccgagggcatcttcctccccagcgagctggagaccccgaacctggccgagcgcgtcctcgactggctggagaagcacggggccgagcggctgcgccggatggccatctccggcgacgactgcgtggtgaagcccatcgacgaccgcttcgcgaccgccctcaccgccctgaacgacatggggaaggtccggaaggacatcccccagtgggagcccagcaagggctggaacgactggcagcaggtcccgttctgctcccaccacttccaccagctgatcatgaaggacgggcgcgagatcgtggtcccctgccggaaccaggacgagctcgtgggccgcgcccgggtgagccagggcgccgggtggtccctgcgcgagacggcgtgcctgggcaagagctacgcccagatgtggcagctcatgtacttccaccggcgcgacctgcggctggccgccaacgcgatctgctccgccgtccccgtggactgggtgcccaccagccgcaccacctggagcatccacgcccaccaccagtggatgacgaccgaggacatgctctccgtctggaaccgcgtgtggatcgaggagaacccgtggatggaggacaagacccacgtgagctcctgggaggaggtcccctacctggggaagcgggaggaccagtggtgcggcagcctgatcgggctcaccgcccgcgccacgtgggcgaccaacatccaggtggccatcaaccaggtgcggcgcctgatcggcaacgagaactacctggactacatgacctccatgaagcggttcaagaacgagagcgaccccgagggcgccctctggtga

SEQ ID NO: 8150 - RNA, 9879 nt, synthetic construct
  misc_feature 1..9879: note = derived and/or modified CDS sequence (opt1) from DENV-1__FJ024484__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcacccggggttcacggtggtggccttcttcctggcgcacgccatcggcaccagcatcacccagaaggggatcatcttcatcctcctgatgctggtcaccccctccatggccatgcgctgcgtgggcatcggcaaccgggacttcgtggaggggctcagcggcgccacgtgggtcgacgtggtgctggagcacgggtcctgcgtcaccaccatggccaagaacaagcccaccctggacatcgagctcctgaagacggaggtgaccaaccccgcgatcctgcgcaagctctgcatcgaggccaagatcagcaacaccaccacggactcccggtgcccgacccagggcgaggccaccctggtggaggagcaggacgccaacttcgtctgccgccggaccttcgtggaccgcggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccgccaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccggctgaagatggacaagctgaccctcaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccgcctgatcaccgccaacccgatcgtcaccgacaaggagaagcccgtgaacatcgagaccgagccgcccttcggggagagctacatcgtgatcggcgccggcgagaaggcgctcaagctgtcctggttcaagaaggggagctccatcggcaagatgttcgaggccacggcccgcggggcccgccggatggccatcctgggcgacaccgcgtgggacttcgggagcatcggcggcgtcttcacctccgtggggaagctcgtgcaccaggtcttcggcaccgcctacggggtgctgttcagcggcgtgtcctggacgatgaagatcgggatcggcatcctgctcacctggctgggcctgaacagccgctccaccagcctctccatgacctgcatcgccgtcgggatggtgacgctgtacctgggcgtgatggtccaggccgacagcgggtgcgtgatcaactggaagggccgcgagctcaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcacggtggtcgtgggggacgccaacggcatcctcgcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacgaccagcgggcctggaacatctgggaggtggaggactacggcttcgggatcttcacgaccaacatctggctgaagctgcgcgactcctacacccagatgtgcgaccaccggctcatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctgtggtccaacggcgtgctcgagagcgagatgatcatccccaagatctacgggggcccgatctcccagcacaactaccggcccgggtacttcacccagacggccggcccctggcacctggggaagctggagctcgacttcgacctgtgcgagggcaccaccgtcgtggtggacgagcactgcggcaaccgcgggccgagcctgcggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctggtgcgcagcatggtctccgccggcagcggcgaggtggacagcttctccctcgggatcctgtgcgccagcatcatgatcgaggaggtgatgcggtcccgctggagccggaagatgctgatgacgggcaccctcgccgtcttcctgctgctcatcatggggcagctgacctggaacgacctgatccgcctctgcatcatggtgggcgcgaacgcctccgaccgcatggggatgggcaccacgtacctggccctgatggccaccttcaagatgcggccgatgttcgccgtgggcctcctgttccgccggctgaccagccgcgaggtcctcctgctgaccatcgggctctccctggtggcgagcgtggagctgcccaactccctcgaggagctgggcgacgggctggccatgggcatcatgatgctcaagctgctgacggagttccagccccaccagctctggaccaccctgctgagcctcaccttcatcaagacgaccctgtccctggactacgcctggaagaccaccgccatggcgctcagcatcgtctccctgttccccctgtgcctcagcacgacctcccagaagaccacctggctgccggtgctgctcggcagcttcgggtgcaagcccctgaccatgttcctgatcacggagaacaagatctggggccggaagtcctggcccctcaacgaggggatcatggccatcggcatcgtcagcatcctgctgtccagcctcctgaagaacgacgtgcccctggccgggccgctcatcgccggcggcatgctgatcgcctgctacgtgatcagcgggtccagcgcggacctgtccctcgagaaggccgccgaggtcagctgggagcaggaggccgagcactccggcaccagccacaacatcctggtggaggtgcaggacgacgggaccatgaagatcaaggacgaggagaaggacgacaccctgacgatcctcctgaaggccaccctgctcgcggtctccggcgtgtaccccatgagcatccccgccaccctgttcgtgtggtacttctggcagaagaagaagcagcgctccggggtcctgtgggacacccccagcccgcccgaggtggagcgggccgtgctcgacgacggcatctaccgcatcctgcagcggggcctgctggggcgctcccaggtcggcgtgggggtgttccaggacggcgtcttccacacgatgtggcacgtgacccgcggggccgtgctcatgtaccagggcaagcgcctggagcccagctgggcctccgtcaagaaggacctgatcagctacggcgggggctggcggttccaggggtcctggaacaccggcgaggaggtccaggtgatcgcggtcgagcccgggaagaacccgaagaacgtgcagaccacgcccggcaccttcaagacccccgagggcgaggtgggggccatcgccctcgacttcaagcccggcaccagcgggtccccgatcgtcaaccgcgagggcaagatcgtgggcctgtacgggaacggcgtggtcacgaccagcgggacctacgtgtccgccatcgcccaggcgaaggccagccaggagggccccctgcccgagatcgaggacgaggtgttcaagaagcggaacctcaccatcatggacctgcacccggggagcggcaagacgcgccggtacctgcccgccatcgtccgcgaggccatcaagcggaagctccgcaccctgatcctggcgcccacccgggtggtggcctccgagatggccgaggccctcaagggcatgcccatccgctaccagaccacggccgtcaagagcgagcacaccgggcgcgagatcgtggacctgatgtgccacgcgaccttcaccatgcggctgctctccccggtgcgcgtccccaactacaacatgatcatcatggacgaggcccacttcacggaccccgccagcatcgccgcccggggctacatctccacccgcgtggggatgggcgaggcggccgccatcttcatgaccgccacgccgcccgggagcgtggaggccttcccccagtccaacgcggtcatccaggacgaggagcgggacatccccgagcgcagctggaactccggctacgactggatcacggacttccccggcaagaccgtgtggttcgtgcccagcatcaagtccgggaacgacatcgccaactgcctgcggaagaacggcaagcgcgtcatccagctgagccggaagaccttcgacaccgagtaccagaagacgaagaacaacgactgggactacgtggtgaccaccgacatctccgagatgggggccaacttccgcgccgcgcgggtcatcgacccccgccggtgcctcaagcccgtgatcctgaaggacggccccgagcgcgtgatcctggccgggccgatgcccgtcaccgtggccagcgccgcccagcggcgcggccggatcggccgcaaccagaacaaggagggggaccagtacgtgtacatgggccagcccctcaacaacgacgaggaccacgcgcactggacggaggccaagatgctgctggacaacatcaacacccccgaggggatcatcccggccctcttcgagcccgagcgggagaagtccgccgccatcgacggcgagtaccgcctgcgcggggaggcgcggaagaccttcgtcgagctgatgcgccggggcgacctccccgtgtggctgagctacaaggtcgcctccgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacctactccgacccgctggccctccgggagttcaaggagttcgccgcggggcgccggagcgtcagcggcgacctgatcctggagatcggcaagctcccccagcacctgacgctgcgcgcccagaacgccctcgacaacctggtgatgctgcacaactccgagcagggcgggaaggcctaccggcacgcgatggaggagctccccgacaccatcgagaccctgatgctgctcgccctgatcgccgtgctgaccgggggcgtcaccctcttcttcctgagcgggaagggcctgggcaagacctccatcgggctcctgtgcgtgaccgccagctccgccctgctctggatggcgagcgtggagccccactggatcgccgcctccatcatcctggagttcttcctgatggtcctcctgatcccggagcccgaccgccagcggacgccccaggacaaccagctggcctacgtggtgatcggcctcctgttcatgatcctgacggtcgccgcgaacgagatggggctcctggagaccaccaagaaggacctgggcatcgggcacgtggccgccgagaaccaccagcacgccaccatgctcgacgtggacctgcgcccggccagcgcgtggacgctgtacgccgtcgccaccaccgtgatcacccccatgatgcggcacacgatcgagaacaccaccgccaacatctccctcaccgccatcgcgaaccaggccgccatcctgatgggcctggacaagggctggcccatcagcaagatggacatcggggtgcccctcctggccctgggctgctactcccaggtcaacccgctcacgctgaccgcggccgtgctgatgctcgtggcccactacgccatcatcgggcccggcctgcaggccaaggcgacccgcgaggcccagaagcggaccgccgccgggatcatgaagaaccccacggtcgacggcatcgtggccatcgacctggaccccgtggtctacgacgcgaagttcgagaagcagctcggccagatcatgctgctgatcctctgcaccagccagatcctgctgatgcgcaccacctgggccctctgcgagtccatcacgctggccaccgggccgctgaccaccctctgggagggcagccccgggaagttctggaacacgaccatcgccgtgtccatggccaacatcttccgcggcagctacctggcgggcgccgggctggccttctccctcatgaagtccctgggcgggggccggcgcgggaccggcgcccagggcgagaccctgggggagaagtggaagcggcagctcaaccagctgacgaagtccgagttcaacacctacaagcgcagcggcatcatggaggtggaccggagcgaggcgaaggaggggctgaagcgcggcgagaccaccaagcacgccgtctcccgggggaccgccaagctccgctggttcgtggagcggaacctggtgaagcccgagggcaaggtcatcgacctgggctgcgggcgcggcgggtggagctactactgcgccggcctgaagaaggtgacggaggtgaaggggtacaccaagggcggccccgggcacgaggagccgatccccatggccacctacggctggaacctcgtcaagctgcactccgggaaggacggcttcttcatgccgcccgagaagtgcgggaccctgctctgcgacatcggcgagagctccccgaaccccacgatcgaggagggccggaccctgcgcgtgctgaagatggtggagccctggctccgggggaaccagttctgcatcaagatcctgaacccctacatgccgagcgtcgtggagaccctggagcagatgcagcgcaagcacggcgggatgctcgtgcggaaccccctgtcccgcaacagcacccacgagatgtactgggtctcctgcggcacgggcaacatcgtgagcgcggtgaacatgacctcccggatgctgctcaaccgcttcaccatggcccaccggaagcccacctacgagcgcgacgtcgacctgggggccggcacgcgccacgtggccgtggagcccgaggtcgccaacctggacatcatcgggcagcggatcgagaacatcaagaacgagcacaagagcacctggcactacgacgaggacaacccgtacaagacctgggcgtaccacggctcctacgaggtgaagcccagcgggtccgccagctccatggtgaacggcgtcgtgcgcctcctgaccaagccctgggacgtgatccccatggtcacgcagatcgccatgaccgacaccaccccgttcggccagcagcgggtgttcaaggagaaggtcgacacgcgcacgccccgggccaagcgcgggaccacccagatcatggaggtgacggccaagtggctgtggggcttcctcagccggaacaagaagccccgcatctgcacccgggaggagttcacccgcaaggtgcggtccaacgcggccatcggggccgtcttcgtggacgagaaccagtggaacagcgccaaggaggcggtggaggacgagcgcttctgggacctggtccaccgggagcgcgagctgcacaagcagggcaagtgcgcgacctgcgtgtacaacatgatggggaagcgggagaagaagctcggcgagttcggcaaggccaaggggagccgcgccatctggtacatgtggctgggcgcccggttcctggagttcgaggcgctcgggttcatgaacgaggaccactggttctcccgcgagaacagcctgtccggcgtggagggggagggcctgcacaagctcggctacatcctgcgggacatcagcaagatccccggcgggaacatgtacgccgacgacacggccgggtgggacacccgcatcaccgaggacgacctgcagaacgaggccaagatcaccgacatcatggagcccgagcacgccctcctggcgacgtccatcttcaagctgacctaccagaacaaggtcgtgcgggtgcagcgccccgccaagaacgggaccgtcatggacgtgatcagccgccgggaccagcgcggctccggccaggtgggcacctacgggctcaacacgttcaccaacatggaggtccagctgatccggcagatggagagcgagggcatcttcctgccctccgagctcgagaccccgaacctggccaagcgcgtgctggactggctcgagaagcacggggccgagcggctgaagcgcatggccatcagcggcgacgactgcgtggtcaagcccatcgacgaccggttcgcgaccgccctgaccgccctcaacgacatgggcaaggtgcgcaaggacatcccccagtgggagccctccaaggggtggaacgactggcagcaggtcccgttctgcagccaccacttccaccagctgatcatgaaggacggccgggagatcgtcgtgccctgccgcaaccaggacgagctggtggggcgggcccgcgtctcccagggcgccgggtggagcctccgggagacggcgtgcctgggcaagtcctacgcccagatgtggcagctgatgtacttccaccgccgggacctccgcctggccgccaacgcgatctgcagcgccgtgcccgtggactgggtccccacctcccggaccacctggagcatccacgcccaccaccagtggatgacgaccgaggacatgctgagcgtgtggaaccgcgtgtggatcgaggagaacccgtggatggaggacaagacccacgtctccagctgggaggaggtgccctacctcggcaagcgggaggaccagtggtgcgggtccctgatcggcctgaccgcccgcgccacgtgggcgaccaacatccaggtggccatcaaccaggtccgccggctcatcgggaacgagaactacctggactacatgaccagcatgaagcgcttcaagaacgagtccgaccccgagggcgccctgtggtga

SEQ ID NO: 8151 - RNA, 9879 nt, synthetic construct
  misc_feature 1..9879: note = derived and/or modified CDS sequence (opt1) from DENV-1__EU596503__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcatcgggagcttcaagctggagaaggaggtcgcggagacccagcacggcacggtgctggtgcaggtcaagtacgagggcaccgacgccccctgcaagatccccttctccacccaggacgagaagggggtgacccagaacggccgcctcatcacggccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcatgttcacctccgtcgggaagctggtgcaccaggtgttcggcaccgcctacggggtcctgttcagcggcgtgtcctggaccatgaagatcgggatcggcatcctcctgacgtggctgggcctcaacagccgctccaccagcctgtccatgacctgcatcgccgtggggatggtcaccctgtacctcggcgtgatggtgcaggccgacagcgggtgcgtcatcaactggaagggccgcgagctgaagtgcgggtccggcatcttcgtgacgaacgaggtgcacacctggaccgagcagtacaagttccaggccgacagcccgaagcggctgagcgcggccatcggcaaggcctgggaggagggggtctgcggcatccgctccgccacccggctcgagaacatcatgtggaagcagatcagcaacgagctgaaccacatcctgctcgagaacgacatgaagttcaccgtggtggtcggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacaaccagcgggcctggaacatctgggaggtggaggactacggcttcgggatcttcaccacgaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctctggtccaacggcgtgctggagagcgagatgatcatccccaagatctacgggggcccgatctcccagcacaactaccggcccgggtacttcacccagaccgccggcccctggcacctggggaagctcgagctggacttcgacctgtgcgagggcacgaccgtggtcgtggacgagcactgcggcaaccgcgggccgagcctccggaccaccacggtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggatcctgtgcgccagcatcatgatcgaggaggtgatgcggtcccgctggagccggaagatgctcatgaccggcacgctggccgtgttcctgctcctgatcaccgggcagctgacctggaacgacctcatccgcctgtgcatcatggtcggcgcgaacgcctccgaccgcatggggatgggcaccacgtacctggccctcatggccaccttcaagatgcggccgatgttcgccgtggggctgctgttccgccggctcaccagccgcgaggtgctgctgctcaccatcgggctgtccctggtcgcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtgtccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggccatcggcatcgtgagcatcctgctctccagcctgctgaagaacgacgtccccctcgccgggccgctgatcgccggcggcatgctgatcgcctgctacgtgatcagcgggtccagcgcggacctctccctggagaaggccgccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggcggtgtccggcgtctaccccatgagcatccccgccaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgcggtggagcccgggaagaacccgaagaacgtccagaccacgcccggcaccttcaagacccccgagggcgaggtgggggccatcgccctggacttcaagcccggcaccagcgggtccccgatcgtgaaccgggagggcaagatcgtcggcctgtacgggaacggcgtggtgacgaccagcgggacctacgtctccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtgcgggaggccatcaagcgcaagctgcggaccctgatcctcgcgcccacccgcgtcgtggcctccgagatggccgaggccctgaagggcatgcccatccgctaccagaccacggccgtcaagagcgagcacaccgggcgggagatcgtcgacctgatgtgccacgcgaccttcaccatgcgcctcctgtccccggtgcgggtgcccaactacaacatgatcatcatggacgaggcccacttcacggaccccgccagcatcgccgcccgcggctacatctccacccgggtcgggatgggcgaggcggccgccatcttcatgaccgccacgccgcccgggagcgtggaggccttcccccagtccaacgcggtgatccaggacgaggagcgcgacatccccgagcggagctggaactccggctacgactggatcacggacttccccggcaagaccgtctggttcgtgcccagcatcaagtccgggaacgacatcgccaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgcggggccgatgcccgtgaccgtcgccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcgtccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgacgctccgggcgcagaacgccctggacaacctggtcatgctccacaactccgagcagggcgggaaggcctaccgccacgccatggaggagctgcccgacaccatcgagaccctgatgctcctggcgctgatcgccgtgctcaccgggggcgtgacgctgttcttcctgagcgggaagggcctcggcaagacctccatcgggctgctgtgcgtcaccgccagctccgccctcctgtggatggccagcgtggagccccactggatcgcggcctccatcatcctggagttcttcctcatggtgctgctgatcccggagcccgaccggcagcgcacgccccaggacaaccagctcgcctacgtcgtgatcggcctgctgttcatgatcctcacggtggccgccaacgagatggggctgctggagaccaccaagaaggacctcggcatcgggcacgtcgcggccgagaaccaccagcacgccaccatgctggacgtggacctgcggccggccagcgcctggacgctctacgcggtggccaccaccgtcatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtgaacccgctgacgctgaccgccgcggtcctcatgctggtggcccactacgccatcatcgggcccggcctgcaggccaaggccacccgggaggcgcagaagcgcaccgccgccgggatcatgaagaaccccacggtggacggcatcgtcgccatcgacctcgaccccgtggtgtacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtctccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgcggtgagccgcgggaccgccaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacacgaagggcggccccgggcacgaggagccgatccccatggccacctacggctggaacctggtgaagctgcacagcgggaaggacgtcttcttcatgccgcccgagaagtgcgacaccctcctgtgcgacatcggcgagtccagcccgaaccccaccatcgaggaggggcgcacgctgcgggtgctcaagatggtggagccctggctgcgcggcaaccagttctgcatcaagatcctgaacccctacatgccgtccgtcgtggagaccctcgagcagatgcagcggaagcacggcgggatgctggtgcgcaaccccctgagccggaactccacccacgagatgtactgggtcagctgcggcaccgggaacatcgtgtccgccgtgaacatgacgagccgcatgctcctgaaccggttcaccatggcgcaccgcaagcccacctacgagcgcgacgtcgacctgggcgccggcacccggcacgtggccgtggagcccgaggtcgccaacctcgacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtgaacggcgtcgtgcggctgctgaccaagccctgggacgtgatccccatggtcacccagatcgccatgacggacaccaccccgttcgggcagcagcgcgtgttcaaggagaaggtcgacacccggacgccccgcgccaagcggggcaccacccagatcatggaggtgaccgccaagtggctctggggcttcctgtcccgcaacaagaagccccggatctgcacgcgcgaggagttcacccggaaggtgcgcagcaacgccgcgatcggggccgtcttcgtggacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgcggacgacaccgccgggtgggacacgcggatcaccgaggacgacctccagaacgaggccaagatcaccgacatcatggagcccgagcacgccctgctggccaccagcatcttcaagctcacgtaccagaacaaggtcgtgcgcgtgcagcgccccgcgaagaacggcaccgtcatggacgtgatctcccggcgcgaccagcgggggagcggccaggtgggcacctacgggctgaacaccttcacgaacatggaggtccagctgatccgccagatggagtccgagggcatcttcctccccagcgagctggagaccccgaacctggccgagcgggtgctcgactggctggagaagcacggggccgagcgcctgaagcggatggccatctccggcgacgactgcgtggtcaagcccatcgacgaccgcttcgccaccgcgctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctcgtggggcgcgcccgggtcagccagggcgccgggtggtccctgcgcgagaccgcctgcctgggcaagagctacgcgcagatgtggcagctcatgtacttccaccggcgcgacctgcggctggccgccaacgccatctgctccgcggtgcccgtggactgggtccccacgagccgcaccacctggagcatccacgcccaccaccagtggatgaccacggaggacatgctctccgtgtggaaccgggtgtggatcgaggagaacccgtggatggaggacaagacccacgtcagctcctgggaggaggtgccctacctggggaagcgcgaggaccagtggtgcggcagcctgatcggcctcaccgcccgcgccacctgggccacgaacatccaggtggcgatcaaccaggtccggcgcctgatcgggaacgagaactacctggactacatgacctccatgaagcggttcaagaacgagagcgaccccgagggcgccctctggtga

SEQ ID NO: 8152 - RNA, 9879 nt, synthetic construct
  misc_feature 1..9879: note = derived and/or modified CDS sequence (opt1) from DENV-1__FJ024479__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctgctgttcaagacctccgcgggggtgaacatgtgcaccctgatcgccatggacctgggggagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggttcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtgggcctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccgccgcgatggccctgagcatcgtctccctgttccccctctgcctgagcaccacgtcccagaagaccacctggctgccggtgctcctgggcagcttcgggtgcaagcccctgaccatgttcctcatcaccgagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcgtgctacgtgatcagcgggtccagcgccgacctctccctggagaaggccgccgaggtcagctgggagcaggaggccgagcactccggcacgagccacaacatcctggtggaggtgcaggacgacgggaccatgaagatcaaggacgaggagcgcgacgacaccctcaccatcctgctgaaggcgacgctcctggccgtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacaccatgtggcacgtgacgcgcggggccgtgctgatgtaccagggcaagcggctggagcccagctgggcgtccgtcaagaaggacctcatcagctacggcgggggctggcgcttccaggggtcctggaacaccggcgaggaggtccaggtgatcgccgtcgagcccgggaagaacccgaagaacgtgcagaccacccccggcacgttcaagacccccgagggcgaggtgggggccatcgccctggacttcaagcccggcaccagcgggtccccgatcgtcaaccgggagggcaagatcgtgggcctgtacgggaacggcgtggtcaccacgagcgggacctacgtgtccgccatcgcgcaggccaaggccagccaggagggccccctccccgagatcgaggacgaggtgttcaagaagcgcaacctgaccatcatggacctgcacccggggagcggcaagacccggcgctacctccccgccatcgtccgggaggcgatcaagcgcaagctgcggacgctgatcctcgcccccacccgcgtggtggcctccgagatggccgaggccctgaagggcatgcccatccgctaccagaccaccgcggtcaagagcgagcacacggggcgggagatcgtggacctgatgtgccacgccaccttcaccatgcgcctcctgtccccggtgcgggtccccaactacaacatgatcatcatggacgaggcccacttcaccgaccccgccagcatcgccgcgcgcggctacatctccacgcgggtggggatgggcgaggccgccgccatcttcatgaccgccacgccgcccgggagcgtggaggcgttcccccagtccaacgccgtcatccaggacgaggagcgcgacatccccgagcggagctggaactccggctacgactggatcaccgacttccccggcaagacggtgtggttcgtgcccagcatcaagtccgggaacgacatcgccaactgcctgcgcaagaacggcaagcgggtcatccagctcagccgcaagaccttcgacaccgagtaccagaagaccaagaacaacgactgggactacgtggtgacgaccgacatctccgagatgggggccaacttccgggcggcccgcgtcatcgacccccggcgctgcctgaagcccgtgatcctgaaggacggccccgagcgggtgatcctcgccgggccgatgcccgtcaccgtggccagcgccgcgcagcgccggggccgcatcggccggaaccagaacaaggagggggaccagtacgtgtacatgggccagcccctgaacaacgacgaggaccacgcccactggaccgaggccaagatgctgctcgacaacatcacgacccccgaggggatcatcccggccctgttcgagcccgagcgcgagaagtccgccgcgatcgacggcgagagccgcctgcgcggggagccccgcaagaccttcgtcgagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggccgaaggagggcgagcgcaagaagctgcggccccgctggctggacgcccggacctacagcgaccccctcgccctgggggagttcaaggagttcggcgccggccgccggagcgggtccggcgcgctgatcctcgagatcgggaagctgccccagcacctcccgctgcgcgcccagaacggcctggacaacctggtcatggtgcacaacagcgagcagggcgggaaggcctaccggcacgccatggaggagctccccgacaccatcgagacgctgatgctgctcgcgctgatcgccgtgctgaccggcggggtcaccctcttcttcctgtccggcaaggggctgggcaagaccagcatcgggctcctgtgcgtgacggcctccagcgccctgctctggatggcctccgtggagccccactggatcgcggccagcatcatcctggagttcttcctgatggtcctcctgatcccggagcccgaccgccagcggacgccccaggacaaccagctggcctacgtggtgatcggcctcctgttcatgatcctgaccgtcgccgccaacgagatgggcctcctggagaccacgaagaaggacctggggatcggccacgtggcggccgagaaccaccagcacgccaccatgctcgacgtggacctgcgccccgcctccgcctggaccctgtacgcggtcgccaccacggtgatcaccccgatgatgcggcacaccatcgagaacaccacggccaacatcagcctcaccgccatcgccaaccaggcggccatcctgatggggctggccaagggctggcccatctccaagatggacatcggggtgcccctcctggccctgggctgctacagccaggtcaaccccctcaccctgaccgcggccgtgctgatgctcgtggcccactacgccatcatcggcccggggctgcaggccaaggcgacgcgcgaggcccagaagcggaccgccgccggcatcatgaagaaccccaccgtcgacgggatcgtggccatcgacctggaccccgtggtctacgacgcgaagttcgagaagcagctcggccagatcatgctgctgatcctctggacctcccagatcctgctgatgcgcacgacctgggccctcggcgagagcatcaccctggccaccgggcccctgacgaccctctgggagggctccccggggaagttctggaacaccaccatcgccgtgagcatggccaacatcttccgcggctcctacctggcgggggccggcctggccttcagcctcatgaagtccctgggcgggggccggcgcgggacgggcgcccagggggagaccctgggcgagaagtggaagcggcagctcaaccagctgagcaagagcgagttcaacacctacaagcgctccggcatcatggaggtggaccggagcgaggcgaaggaggggctgaagcgcggcgagaccacgaagcacgccgtctcccgggggaccgccaagctccgctggttcgtggagcggaacctggtgaaccccgagggcaaggtcatcgacctggggtgcggccgcggcgggtggagctactactgcgccggcctgaagaaggtgaccgaggtgaaggggtacaccaagggcgggcccggccacgaggagcccatcccgatggccacctacggctggaacctcgtcaagctgcactccgggaaggacgtgttcttcatcccgcccgagaagtgcgacacgctgctctgcgacatcggcgagagctcccccaacccgaccatcgaggaggggcggaccctgcgcggcctgaagatggtggagccctggctccggggcaaccagttctgcatcaagatcctgaacccctacatgcccagcgtcgtggagaccctggagcagatgcagcgcaagcacgggggcatgctcgtgcggaacccgctgtcccgcaacagcacgcacgagatggactgggtctcctgcgggaccggcaacatcgtgagcgcggtgaacatgacctcccggatgctgctcaaccgcttcaccatggcccaccggaagcccacgtacgagcgcgacgtcgacctgggggccggcacccgccacgtggccgtggagcccgaggtcgccaacctggacatcatcggccagcggatcgagaacatcaagaacgagcacaagagcacctggcactacgacgaggacaacccctacaagacctgggcgtaccacgggtcctacgaggtgaagccgagcggctccgccagctccatggtgaacggggtcgtgcgcctcctgacgaagccctgggacgtgatccccatggtcacccagatcgccatgaccgacaccacgccgttcggccagcagcgggtgttcaaggagaaggtcgacacccgcacgccccgggccaagcgcgggaccacgcagatcatggaggtgaccgccaagtggctgtggggcttcctcagccggaacaagaagccccgcatctgcacccgggaggagttcacccgcaaggtgcggagcaacgcggccatcggcgccgtcgtggtggacgagaaccagtggaactccgccaaggaggcgggggaggacgagcgcgtctgggacctgggcgaccgggagcgcgagctgcacaagcaggggaagtgcgccacgtgcggctacaacatgatggggaagcgggagaagaagctcggcgagttcggcaaggccaaggggagccgcgccatctggtacatgtggctgggcgcccggttcctggagttcgaggcgctcgggttcatgaacgaggaccactggttctcccgcgagaacagcctgtccggcgtggagggcgaggggctgcacaagctcggctacatcctgcgggacatcagcaagatccccgggggcaacatgtacgccgacgacaccgccgggtgggacacccgcatcaccgaggacgacctgcagaacgaggccaagatcacggacatcatggagccggagcacgccctcctggcgacctccatcttcaagctgacctaccagaacaaggtggtccgggtgcagcgccccgccaagaacggcaccgtgatggacgtcatcagccgccgggcccagcgcggctccggccaggtgggcacgtacgggctcaacaccttcaccaacatggaggtgcagctgatccggcagatggagagcgagggcatcttcctgccctccgagctcgagacccccaacctggccgagcgcgtcctggactggctcgagaagcacggggccgagcggctgaagcgcatggcgatcagcggcgacgactgcgtggtgaagccgatcgacgaccggttcgccacggccctgaccgccctcaacgacatgggcaaggtccgcaaggacatcccccagtgggagccctccaaggggtggaacgactggcagcaggtcgccttctggagccaccacttccaccagctgatcatgaaggacggccgggagatcgtggtcccctgccgcaaccaggacgagctcggcgggcgggcgcgcgtgtcccagggggccgggtggagcctccgggagaccgcctgcctgggcaagtcctacgcccagatgtggcagctgatgtacttccaccgccgggacctccgcctggcggccaacgccatctgcagcgccgtgccggtcgactgggtgcccaccagccggaccacgtggtccatccacgcccaccaccagtggatgaccaccgaggacatgctgagcgtgtggaaccgcgtctggatcgaggagaacccctggatggaggacaagacccacgtgtccagctgggaggaggtgccctacctcgggaagcgggaggaccagtggtgcggctccctgatcgggctgacggcgcgcgccacctgggccaccaacatccaggtcgccatcaaccaggtgcgccggctcatcggcaacgagaactacctggactacatgaccagcatgaagcgcttcaagaacgagtccgacccggagggggccctgtggtga

SEQ ID NO: 8153 - RNA, 9879 nt, synthetic construct
  misc_feature 1..9879: note = derived and/or modified CDS sequence (opt1) from DENV-1__FJ182002__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggggagctctgcgaggacaccatgacctacaagtgcccccagatcaccgaggccgagcccgacgacgtggactgctggtgcaacgccaccgacacgtgggtgacctacgggacctgcagccagaccggggagcaccggcgggacaagcgctccgtggccctggcgccccacgtgggcctggggctcgagacgcggaccgagacctggatgagctccgagggcgcctggaagcagatccagcgcgtcgagacctgggccctgcggcacccggggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcaccgggcagctgacctggaacgacctcatccgcctgtgcatcatggtgggcgcgaacgcctccgaccgcatggggatgggcacgacctacctggccctcatggccaccttcaagatgcggccgatgttcgccgtgggcctgctgttccgccggctcaccagccgcgaggtcctgctgctcacgatcgggctgtccctggtggcgagcgtggagctccccaactccctggaggagctgggcgacgggctcgccatgggcatcatgatgctgaagctgctcaccgagttccagccccaccagctgtggaccaccctgctcagcctgacgttcatcaagaccaccctgtccctcgactacgcctggaagaccacggccatggcgctgagcatcgtctccctgttccccctctgcctgagcaccacctcccagaagaccacctggctgccggtgctcctgggcagcttcgggtgcaagcccctgacgatgttcctcatcaccgagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacacgctcaccatcctgctgaaggccaccctcctggcggtctccggcgtgtaccccatgagcatccccgccaccctgttcgtgtggtacttctggcagaagaagaagcagcggtccggggtcctctgggacacgcccagcccgcccgaggtggagcgcgccgtgctggacgacggcatctaccggatcctgcagcgcggcctgctcgggcggtcccaggtcggcgtgggggtgttccaggacggcgtcttccacaccatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagacgacccccggcaccttcaagacccccgagggcgaggtgggggccatcgccctggacttcaagcccggcacgagcgggtccccgatcgtcaaccgggagggcaagatcgtgggcctgtacgggaacggcgtggtcaccaccagcgggacctacgtgtccgccatcgcccaggcgaaggccagccaggagggccccctccccgagatcgaggacgaggtgttcaagaagcgcaacctgacgatcatggacctgcacccggggagcggcaagacccggcgctacctccccgccatcgtccgggaggccatcaagcgcaagctgcggaccctgatcctcgcgcccacccgcgtggtggcctccgagatggccgaggccctgaagggcatgcccatccgctaccagacgaccgccgtcaagagcgagcacaccgggcgggagatcgtggacctgatgtgccacgcgaccttcacgatgcgcctcctgtccccggtgcgggtccccaactacaacatgatcatcatggacgaggcccacttcaccgaccccgccagcatcgccgcccgcggctacatctccacccgggtggggatgggcgaggcggccgccatcttcatgaccgccacgcccccggggagcgtggaggccttcccccagtccaacgcggtcatccaggacgaggagcgcgacatccccgagcggagctggaactccggctacgactggatcaccgacttccccggcaagaccgtgtggttcgtgccgagcatcaagtccgggaacgacatcgccaactgcctgcgcaagaacggcaagcgggtcatccagctcagccgcaagaccttcgacacggagtaccagaagaccaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcacggtggccagcgccgcccagcgccggggccgcatcggccggacccagaccaaggagggggaccagtacgtgtacatgggccagcccctgaacaacgacgaggaccacgcccactggaccgaggcgaagatgctgctcgccaacatcaacacccccgaggggatcatcccggccctgttcgagcccgagcgcgagaagtcccccgccatcgacggcgagtaccgcctgcgcggggaggcccgcaagacgttcgtcgagctcatgcggcgcggcgacctgcccgtgtggctgagctacaaggtcgcgtccgagggcttccagtacagcgaccggcgctggtggttcgacggggagcggaacaaccaggtgctcgaggagaacatggacgtggagatctggaccaaggagggcgagcgcaagaagctgcggccgcgctggctggacgcccggacctactccgaccccctcgccctgggggagttcaaggagttcggcgccggccgccggagcgggagcggcgacctgatcctcgagatcgggaagctgccccagcacctgaccctccgcgcccagaacggcctggacaacctggtcatggtgcacaactccgagcagggcgggaaggcgtaccggcacgccatggaggagctccccgacacgatcgagaccctgatgctgctcgccctgatcgccgtgctgaccggcggggtcaccctcttcttcctgagcggcaaggggctgggcaagacgtccatcgggctcctgtgcgtgaccgcgagctccgccctgctctggatggccagcgtggagccgcactggatcgccgcctccatcatcctggagttcttcctgatggtcctcctgatccccgagcccgaccgccagcggaccccgcaggacaaccagctggcgtacgtggtgatcggcctcctgttcatgatcctgaccgtcgccgccaacgagatgggcctcctggagacgaccaagaaggacctggggatcggccacgtggccgccgagaaccaccagcacgcgaccatgctcgacgtggacctgcgccccgccagcgcctggaccctgtacgccgtcgccacgaccgtgatcacccccatgatgcggcacaccatcgagaacacgaccgcgaacatctccctcaccgccatcgccaaccaggccgccatcctgatggggctggacaagggctggcccatcagcaagatggacatcggggtgccgctcctggcgctgggctgctactcccaggtcaaccccctcaccctgacggccgccgtgctgatgctcgtggcccactacgcgatcatcggccccgggctgcaggccaaggccacccgcgaggcccagaagcggaccgccgcgggcatcatgaagaaccccaccgtcgacgggatcgtggccatcgacctggacccggtggtctacgacgccaagttcgagaagcagctcggccagatcatgctgctgatcctctgcacgagccagatcctgctgatgcgcaccacctgggccctctgcgagtccatcaccctggccacgggccccctgaccaccctctgggaggggagccccggcaagttctggaacaccacgatcgcggtgtccatggccaacatcttccgcgggagctacctggccggcgccgggctggccttctccctcatgaagtccctgggcggcgggcggcgcggcaccggggcgcagggcgagaccctgggggagaagtggaagcggcagctcaaccagctgtccaagagcgagttcaacacctacaagcgcagcggcatcatggaggtggaccggtccgaggccaaggagggcctgaagcgcggggagaccacgaagcacgccgtcagccggggcaccgccaagctccgctggttcgtggagcggaacctggtgaagcccgaggggaaggtcatcgacctgggctgcgggcgcggcggctggtcctactactgcgcggggctgaagaaggtgaccgaggtgaagggctacaccaagggcgggccggggcacgaggagcccatccccatggccacgtacggctggaacctcgtcaagctgcacagcggcaaggacgtgttcttcatgcccccggagaagtgcgacaccctgctctgcgacatcggggagtccagccccaaccccaccatcgaggagggccggaccctgcgcgtgctgaagatggtcgagccctggctccgggggaaccagttctgcatcaagatcctgaacccgtacatgccctccgtggtggagacgctggagcagatgcagcgcaagcacggcggcatgctcgtccggaaccccctgagccgcaactccacccacgagatgtactgggtgagctgcgggaccggcaacatcgtgtccgccgtcaacatgaccagccggatgctgctcaaccgcttcacgatggcccaccggaagcccacctacgagcgcgacgtggacctgggggccggcacccgccacgtggcggtcgagccggaggtggccaacctggacatcatcgggcagcggatcgagaacatcaagaacgagcacaagtccacctggcactacgacgaggacaacccctacaagacgtgggcctaccacggcagctacgaggtgaagccctccggcagcgcctccagcatggtcaacggggtggtgcgcctcctgaccaagccctgggacgtcatcccgatggtgacccagatcgccatgaccgacacgacccccttcggccagcagcgggtcttcaaggagaaggtggacacccgcacgccccgggcgaagcgcgggacgacccagatcatggaggtgaccgccaagtggctgtggggcttcctctcccggaacaagaagccgcgcatctgcacccgggaggagttcacgcgcaaggtccggagcaacgccgccatcggggccgtgttcgtggacgagaaccagtggaacagcgcgaaggaggccggcgaggacgagcgcgtctgggacctggtggaccgggagcgcgagctgcacaagcagggcaagtgggggaccggcgggtacaacatgatgggcaagcgggagaagaagctcggggagttcggcaaggccaagggctcccgcgggatctggtacatgtggctgggcgcccggttcctggagttcgaggcgctcgggttcatgaacgaggaccactggttcagccgcgagaactccctgagcggcgtggagggcgaggggctgcacaagctcggctacatcctgcgggacatctccaagatccccgggggcaacatgtacgccgacgacaccgccgggtgggacacccgcatcacggaggacgacctgcagaacgaggccaagatcaccgacatcatggagcccgagcacgccctcctggcgaccagcatcttcaagctgacctaccagaacaaggtcgtgcgggtgcagcgccccgccaagaacggcacggtcatggacgtgatctcccgccgggaccagcgcggcagcggccaggtgggcacctacgggctcaacaccttcaccaacatggaggtccagctgatccggcagatggagtccgagggcatcttcctgccgagcgagctcgagacccccaacctggccgagcgcgtgctggactggctcgagaagcacggggccgagcggctgaagcgcatgcccatctccggcgacgactgcgtggtcaagcccatcgacgaccggttcgccacggcgctgaccgccctcaacgacatgggcaaggtgcgcaaggacatcccgcagtgggagcccagcaaggggtggaacgactggcagcaggtccccttctggtcccaccacttccaccagctgatcatgaaggacggccgggagatcgtcgtgccctgccgcaaccaggacgagctggtggggcgggcccgcgtcagccagggcgccgggtggtccctccgggagaccgcctggctgggcaagagctacgcgcagatgggccagctgatgtacttccaccgccgggacctccgcctggccgccaacgccatctggtccgccgggccgggcgactgggtgcccaccagccggacgacctggagcatccacgcgcaccaccagtggatgaccaccgaggacatgctgtccgtgtggaaccgcgtctggatcgaggagaacccctggatggaggacaagacgcacgtgagctcctgggaggaggtgccctacctcgggaagcgggaggaccagtggtgcggcagcctgatcgggctgaccgcccgcgccacctgggccaccaacatccaggtcgcgatcaaccaggtgcgccggctcatcggcaacgagaactacctggactacatgacgtccatgaagcgcttcaagaacgagagcgacccggagggcgccctgtggtga

SEQ ID NO: 8154 - RNA, 9879 nt, synthetic construct
  misc_feature 1..9879: note = derived and/or modified CDS sequence (opt1) from DENV-1__FJ024482__SS-prME
  source 1..9879: mol_type = other RNA
agcgtgaccatgctgctcatgctgctgcccaccgccctcgccttccacctgaccacccggggcggggagccgcacatgatcgtgagcaagcaggagcggggcaagagcctcctgttcaagacctccgccggggtgaacatgtgcaccctgatcgccatggacctgggcgagctctgcgaggacaccatgacctacaagtgcccccagatcaccgaggccgagcccgacgacgtggactgctggtgcaacgccaccgacacgtgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgggtggagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctgttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttcctcacccaggacgagaagggggtgacgcagaacggccgcctgatcaccgccaacccgatcgtgaccgacaaggagaagcccgtcaacatcgagaccgagccgcccttcggggagtcctacatcgtggtgggcgccggcgagaaggcgctgaagctcagctggttcaagaaggggtccagcatcggcaagatgttcgaggccacggcccgcggggcccgccggatggccatcctgggcgacaccgcgtgggacttcgggtccatcggcggcgtcttcaccagcgtggggaagctggtgcaccaggtcttcggcaccgcctacggggtcctcttctccggcgtgagctggacgatgaagatcgggatcggcatcctgctgacctggctcggcctgaactcccgcagcacctccctgagcatgacctgcatcgccgtcgggatggtgacgctctacctgggcgtgatggtccaggccgactccgggtgcgtgatcaactggaagggccgcgagctgaagtgcgggagcggcatcttcgtgaccaacgaggtccacacctggaccgagcagtacaagttccaggccgactccccgaagcggctcagcgcggccatcggcaaggcctgggaggagggggtgtgcggcatccgcagcgccacccggctggagaacatcatgtggaagcagatctccaacgagctgaaccacatcctcctggagaacgacatgaagttcacggtggtcgtgggggacgccaacggcatcctggcgcaggggaagaagatgatccgcccccagcccatggagcacaagtacagctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctcaagctgcgcgacagctacacccagatgtgcgaccaccggctgatgtccgcggccatcaaggacagcaaggccgtccacgccgacatgggctactggatcgagtccgagaagaacgagacctggaagctcgcccgcgcgagcttcatcgaggtgaagacgtgcacctggcccaagtcccacaccctgtggagcaacggcgtgctggagtccgagatgatcatccccaagatctacgggggcccgatcagccagcacaactaccggcccgggtacttcacccagacggccggcccctggcacctcgggaagctggagctggacttcgacctctgcgagggcaccaccgtcgtggtggacgagcactgcggcaaccgcgggccgtccctgcggaccacgaccgtcaccggcaagatcatccacgagtggtgctgccgcagctgcaccctgccgcccctccggttccgcggggaggacggctgctggtacgggatggagatccggcccgtgaaggagaaggaggagaacctggtgcgctccatggtcagcgccggctccggcgaggtggacagcttcagcctggggatcctctgcgcctccatcatgatcgaggaggtgatgcggagccgctggtcccggaagatgctgatgacgggcaccctggccgtcttcctcctgctgatcatggggcagctcacctggaacgacctgatccgcctgtgcatcatggtgggcgcgaacgccagcgaccgcatggggatgggcaccacgtacctcgccctgatggccaccttcaagatgcggccgatgttcgccgtggggctcctcttccgccggctgacctcccgcgaggtcctgctcctgaccatcgggctgagcctcgtggcgtccgtggagctgcccaacagcctggaggagctcggcgacgggctggccatgggcatcatgatgctgaagctcctgacggagttccagccccaccagctgtggaccaccctcctgtccctgaccttcatcaagacgaccctcagcctggactacgcctggaagaccaccgccatggcgctgtccatcgtcagcctcttccccctgtgcctgtccacgaccagccagaagaccacctggctcccggtgctgctgggctccttcgggtgcaagcccctcaccatgttcctgatcacggagaacaagatctggggccgcaagagctggcccctgaacgaggggatcatggccatcggcatcgtctccatcctcctgagctccctgctcaagaacgacgtgcccctggccgggccgctgatcgccggcggcatgctcatcgcctgctacgtgatcagcgggagctccgcggacctgagcctggagaaggccgccgaggtctcctgggagcaggaggccgagcacagcggcacctcccacaacatcctcgtggaggtgcaggacgacgggaccatgaagatcaaggacgaggagcgcgacgacaccctgacgatcctgctcaaggccaccctgctggcggtcagcggcgtgtaccccatgtccatccccgccaccctcttcgtgtggtacttctggcagaagaagaagcagcggagcggggtcctgtgggacaccccctccccgcccgaggtggagcgcgccgtgctggacgacggcatctaccggatcctgcagcgcggcctcctggggcggagccaggtcggcgtgggggtgttccaggacggcgtcttccacacgatgtggcacgtgacccgcggggccgtgctgatgtaccagggcaagcggctcgagccctcctgggccagcgtcaagaaggacctgatctcctacggcgggggctggcgcttccaggggagctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcacctccgggagcccgatcgtcaaccgggagggcaagatcgtgggcctctacgggaacggcgtggtcacgacctccgggacctacgtgagcgccatcgcccaggcgaaggcctcccaggagggccccctgcccgagatcgaggacgaggtgttcaagaagcgcaacctgaccatcatggacctccacccggggagcggcaagacgcggcgctacctgcccgccatcgtccgggaggccatcaagcgcaagctgcggaccctcatcctggcgcccacccgcgtggtggccagcgagatggccgaggccctgaagggcatgcccatccgctaccagaccacggccgtcaagtccgagcacaccgggcgggagatcgtggacctcatgtgccacgcgaccttcaccatgcgcctgctgagcccggtgcgggtccccaactacaacatgatcatcatggacgaggcccacttcacggaccccgcctccatcgccgcccgcggctacatcagcacccgggtggggatgggcgaggcggccgccatcttcatgaccgccacgccgcccgggtccgtggaggccttcccccagagcaacgcggtcatccaggacgaggagcgcgacatccccgagcggtcctggaacagcggctacgactggatcacggacttccccggcaagaccgtgtggttcgtgccctccatcaagagcgggaacgacatcgccaactgcctccgcaagaacggcaagcgggtcatccagctgtcccgcaagaccttcgacaccgagtaccagaagacgaagaacaacgactgggactacgtggtgaccaccgacatcagcgagatgggggccaacttccgggccgaccgcgtcatcgacccccggcgctgcctgaagcccgtgatcctcaaggacggccccgagcgggtgatcctggcggggccgatgcccgtcaccgtggcctccgccgcccagcgccggggccgcatcggccggaaccagaacaaggagggggaccagtacgtgtacatgggccagcccctgaacaacgacgaggaccacgcccactggacggaggcgaagatgctcctggacaacatcaacacccccgaggggatcatcccggccctgttcgagcccgagcgcgagaagtccgccgccatcgacggcgagtaccgcctccgcggggaggcccgcaagaccttcgtcgagctgatgcggcgcggcgacctgcccgtgtggctctcctacaaggtcgcgagcgagggcttccagtactccgaccggcgctggtgcttcgacggggagcggaacaaccaggtgctggaggagaacatggacgtggagatctggcccaaggagggcgagcgcaagaagctgcggccgcgctggctcgacgcccggacctacagcgaccccctggccctgcgcgagttcaaggagttcgccgccgggcggcgctccgtcagcggcgacctcatcctggagatcggcaagctgccccagcacctcaccctgcgggcgcagaacgccctggacaacctcgtgatggtgcacaacagcgagcagggcgggaaggcctaccgccacgccatggaggagctgcccgacacgatcgagaccctgatgctcctggcgctgatcgccgtcctcaccgggggcgtgaccctgttcttcctgtccgggaagggcctcggcaagacgagcatcgggctgctgtgcgtgaccgcctccagcgccctcctgtggatggcctccgtcgagccgcactggatcgcggccagcatcatcctggagttcttcctcatggtgctgctgatccccgagcccgaccggcagcgcaccccgcaggacaaccagctcgcctacgtggtcatcggcctgctgttcctcatcctgaccgtggccgccaacgagatggggctgctcgagacgaccaagaaggacctgggcatcgggcacgtggcggccgagaaccaccagcacgccaccatgctggacgtcgacctccggcccgcctccgcctggaccctgtacgcggtggccacgaccgtgatcacccccatgatgcgccacaccatcgagaacacgaccgccaacatcagcctgaccgccatcgccaaccaggcggccatcctcatgggcctggacaagggctggcccatctccaagatggacatcggggtcccgctgctcgccctgggctgctacagccaggtgaaccccctgaccctcacggccgcggtgctgatgctggtcgcccactacgccatcatcgggcccggcctccaggccaaggccacccgggaggcgcagaagcgcaccgccgccgggatcatgaagaaccccaccgtggacggcatcgtggccatcgacctggacccggtcgtgtacgacacgaagttcgagaagcagctgggccagatcatgctcctgatcctgtgcacctcccagatcctcctgatgcgcaccacctgggccctgtgcgagagcatcacgctcgcgaccgggcccctgaccaccctgtgggagggctcccccgggaagttctggaacacgaccatcgccgtgagcatggccaacatcttccggggctcctacctcgccggcgccgggctggcgttcagcctgatgaagtccctcggcgggggccgccgggggaccggcgcccagggcgagaccctgggggagaagtggaagcgccagctgaaccagctcagcaagtccgagttcaacacgtacaagcggagcggcatcatggaggtcgaccgcagcgaggccaaggaggggctgaagcggggcgagaccaccaagcacgccgtgtcccgcgggaccgcgaagctgcggtggttcgtggagcgcaacctggtcaagcccgagggcaaggtgatcgacctcggctgcgggcggggcgggtggagctactactgcgccggcctgaagaaggtgaccgaggtcaaggggtacacgaagggcggcccggggcacgaggagcccatccccatggccacctacggctggaacctggtgaagctccactccgggaaggacgtgttcttcatgcccccggagaagtgcgacaccctgctgtgcgacatcggcgagagctcccccaaccccaccatcgaggaggggcgcacgctccgggtcctgaagatggtggagccctggctgcgcggcaaccagttctgcatcaagatcctcaacccgtacatgcccagcgtggtcgagaccctggagcagatgcagcggaagcacggcgggatgctggtgcgcaaccccctctcccggaacagcacccacgagatgtactgggtgtcctgcggcaccgggaacatcgtcagcgccgtgaacatgacgtcccgcatgctgctgaaccggttcaccatggcccaccgcaagcccacctacgagcgcgacgtggacctcggcgcgggcacccggcacgtcgccgtggagccggaggtggccaacctggacatcatcgggcagcgcatcgagaacatcaagaacgagcacaagagcacgtggcactacgacgaggacaacccctacaagacctgggcctaccacggctcctacgaggtcaagcccagcgggtccgccagctccatggtgaacggcgtggtccggctgctcaccaagccctgggacgtgatcccgatggtcacccagatcgcgatgacggacaccacccccttcgggcagcagcgcgtgttcaaggagaaggtggacacccggacgccccgcgccaagcggggcaccacccagatcatggaggtcaccgccaagtggctgtggggcttcctgagccgcaacaagaagccgcggatctgcacgcgcgaggagttcacccggaaggtgcgctccaacgccgccatcggggcggtgttcgtcgacgagaaccagtggaacagcgccaaggaggccgtggaggacgagcggttctgggacctcgtgcaccgcgagcgggagctgcacaagcagggcaagtgcgcgacctgcgtctacaacatgatggggaagcgcgagaagaagctgggcgagttcgggaaggcgaagggcagccgggccatctggtacatgtggctcggcgcccgcttcctggagttcgaggccctggggttcatgaacgaggaccactggttctcccgggagaacagcttctccggcgtggagggggagggcctccacaagctggggtacatcctgcgcgacatcagcaagatccccggcggcaacatgtacgccgacgacaccgcggggtgggacacgcggatcaccgaggacgacctccagaacgaggccaagatcaccgacatcatggagcccgagcacgccctgctggccacctccatcttcaagctcacgtaccagaacaaggtggtccgcgtgcagcgccccgccaagaacggcaccgtgatggacgtcatcagccggcgcgcgcagcgggggtccggccaggtgggcacctacgggctgaacaccttcacgaacatggaggtgcagctgatccgccagatggagagcgagggcatcttcctcccgtccgagctggagacccccaacctggccgagcgggtcctcgactggctggagaagcacggggccgagcgcctgaagcggatggccatcagcggcgacgactgcgtggtgaagcccatcgacgaccgcttcgccaccgcgctcaccgccctgaacgccatggggaaggtccggaaggacatcccccagtgggagccgtccaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgccgggtggagcctgcgcgagaccgcgtgcctgggcaagtcctacgcccagatgtggcagctcatgtacttccaccggcgcgacctgcggctggccgccaacgcgatctgcagcgccgtccccgtggactgggtgccgacgtcccgcaccacctggagcatccacgcccaccaccagtggatgaccacggaggacatgctcagcgtctggaaccgggtgtggatcgaggagaacccctggatggaggacaagacccacgtgtccagctgggaggaggtcccctacctggggaagcgcgaggaccagtggtgcggctccctgatcggcctcaccgcccgcgccacctgggcgacgaacatccaggtggccatcaaccaggtgcggcgcctgatcgggaacgagaactacctggactacatgaccagcatgaagcggttcaagaacgagtccgaccccgagggcgccctctggtga

SEQ ID NO: 8155 - RNA, 9879 nt, synthetic construct
  misc_feature 1..9879: note = derived and/or modified CDS sequence (opt1) from DENV-1__EU596501__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctgttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgcccctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgctccccctgtgcctgagcacgacctcccagaagaccacctggctcccggtgctgctgggcagcttcgggtgcaagcccctcaccatgttcctgatcacggagaacaagatctggggccggaagtcctggcccctgaacgaggggatcatggccatcggcatcgtcagcatcctcctgtccagcctgctcaagaacgacgtgcccctggccgggccgctgatcgccggcggcatgctcatcgcctgctacgtgatcagcgggtccagcgcggacctgtccctggagaaggccgccgaggtcagctgggagcaggaggccgagcactccggcaccagccacaacatcctcgtggaggtgcaggacgacgggaccatgaagatcaaggacgaggagcgcgacgacaccctgacgatcctgctcaaggccaccctgctggcggtctccggcgtgtaccccatgagcatccccgccaccctcttcgtgtggtacttctggcagaagaagaagcagcggtccggggtcctgtgggacacccccagcccgcccgaggtggagcgcgccgtgctggacgacggcatctaccggatcatgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagaccctggagggcgaggtgggggccatcgccctggacttcaagcccggcaccagcgggtcccccatcgtcaaccgggagggcaagatcgtgggcctctacgggaacggcgtggtcacgaccagcgggacctacgtgtccgccatcgcccaggcgaaggccagccaggagggcccgctgcccgagatcgaggacgaggtgttcaagaagcgcaacctgaccatcatggacctccaccccgggagcggcaagacgcggcgctacctgccggccatcgtccgggaggccatcaagcgcaagctgcggaccctcatcctggcgcccacccgcgtggtggcctccgagatggccgaggccctgaagggcatgcccatccgctaccagaccacggccgtcaagagcgagcacaccgggcgggagatcgtggacctcatgtgccacgcgaccttcaccatgcgcctgctgtcccccgtgcgggtcccgaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccgcagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctccgcaagaacggcaagcgggtcatccagctgagccgcaagaccttcgacaccgagtaccagaagacgaagaacaacgactgggactacgtggtgaccaccgacatctccgagatgggggccaacttccgggccgaccgcgtcatcgacccgcggcgctgcctgaagcccgtgatcctcaaggacggccccgagcgggtgatcctggcggggcccatgccggtcaccgtggccagcgccgcccagcgccggggccgcatcggccggaaccagaacaaggagggggaccagtacgtgtacatgggccagcccctgaacaacgacgaggaccacgcccactggacggaggcgaagatgctcctggacaacatcaacacccccgaggggatcatccccgccctgttcgagccggagcgcgagaagtccgccgccatcgacggcgagtaccgcctccgcggggaggcccgcaagaccttcgtcgagctgatgcggcgcggcgacctgcccgtgtggctcagctacaaggtcgcgtccgagggcttccagtacagcgaccggcgctggtgcttcgacggggagcggaacaaccaggtgctggaggagaacatggacgtggagatctggaccaaggagggcgagcgcaagaagctgcggccccgctggctcgacgcccggacctactccgaccccctggccctgcgcgagttcaaggagttcgccgccgggcggcgcagcgtcagcggcgacctcatcctggagatcggcaagctgccgcagcacctcacgctgcgggcgcagaacgccctggacaacctcgtgatgctgcacaactccgagcagggcgggaaggcctaccgccacgccatggaggagctgcccgacaccatcgagaccctcatgctgctggcgctcatcgccgtgctgaccgggggcgtcacgctgttcttcctcagcgggaagggcctgggcaagacctccatcgggctgctctgcgtgaccgccagctccgccctgctgtggatggccagcgtggagccccactggatcgcggcctccatcatcctcgagttcttcctgatggtcctgctcatccccgagccggaccggcagcgcacgccccaggacaaccagctggcctacgtggtgatcggcctcctcttcatgatcctgacggtcgccgccaacgagatggggctgctcgagaccaccaagaaggacctgggcatcgggcacgtggcggccgagaaccaccagcacgccaccatgctggacgtggacctccggcccgccagcgcctggacgctgtacgcggtcgccaccaccgtgatcaccccgatgatgcgccacacgatcgagaacaccaccgccaacatctccctgaccgccatcgccaaccaggcggccatcctcatgggcctggacaagggctggcccatcagcaagatggacatcggggtgcccctgctcgccctgggctgctactcccaggtcaaccccctgacgctcaccgccgcggtgctgatgctggtggcccactacgccatcatcgggccgggcctccaggccaaggccacccgggaggcgcagaagcgcaccgccgccgggatcatgaagaaccccacggtcgacggcatcgtggccatcgacctggaccccgtggtctacgacgccaagttcgagaagcagctgggccagatcatgctcctgatcctgtgcaccagccagatcctcctgatgcgcaccacctgggcgctgtgcgagtccatcacgctcgccaccgggcccctgaccaccctgtgggagggcagcccggggaagttctggaacacgaccatcgccgtgtccatggccaacatcttccggggcagctacctcgccggcgcggggctggccttctccctgatgaagtccctcggcgggggccgccgggggaccggcgcccagggcgagaccctgggggagaagtggaagcgccagctgaaccagctctccaagagcgagttcaacacgtacaagcggagcggcatcatggaggtggaccgctccgaggccaaggaggggctgaagcggggcgagaccaccaagcacgcggtcagccgcgggaccgccaagctgcggtggttcgtggagcgcaacctggtgaagcccgagggcaaggtcatcgacctcggctgcgggcggggcgggtggtcctactactgcgccggcctgaagaaggtgaccgaggtgaaggggtacacgaagggcggccccgggcacgaggagcccatcccgatggccacctacggctggaacctggtcaagctccacagcgggaaggacgtgttcttcatgccgcccgagaagtgcgacaccctgctgtgcgacatcggcgagtccagccccaacccgaccatcgaggaggggcgcacgctccgggtgctgaagatggtcgagccctggctgcgcggcaaccagttctgcatcaagatcctcaacccctacatgccctccgtggtggagaccctggagcagatgcagcggaagcacggcgggatgctggtccgcaacccgctcagccggaactccagccacgagatgtactgggtgtcctgcggcaccgggaacatcgtgagcgccgtcaacatgacctcccgcatgctgctgaaccggttcacgatggcgcaccgcaagcccacctacgagcgcgacgtggacctcggcgccggcacccggcacgtggccgtcgagcccgaggtggccaacctggacatcatcgggcagcgcatcgagaacatcaagaacgagcacaagagcacctggcactacgacgaggacaacccctacaagacgtgggcctaccacggctcctacgaggtgaagccgagcgggtccgcgagctccatggtcaacggcgtggtgcggctgctcaccaagccctgggacgtcatccccatggtgacccagatcgccatgaccgacacgacccccttcgggcagcagcgcgtcttcaaggagaaggtggacacccggaccccgcgcgccaagcggggcacgacccagatcatggaggtgaccgccaagtggctgtggggcttcctgagccgcaacaagaagccccggatctgcacccgcgaggagttcacgcggaaggtccgcagcaacgccgcgatcggggccgtgttcgtggacgagaaccagtggaactccgccaaggaggccgtcgaggacgagcggttctgggacctcgtgcaccgcgagcgggagctgcacaagcagggcaagtgcgcgacctgcgtgtacaacatgatggggaagcgcgagaagaagctgggcgagttcgggaaggccaagggcagccgggccatctggtacatgtggctcggcgcccgcttcctggagttcgaggccctggggttcatgaacgaggaccactggttctcccgggagaacagcctctccggcgtcgagggggagggcctgcacaagctggggtacatcctccgcgacatcagcaagatccccggcggcaacatgtacgcggacgacaccgccgggtgggacacccggatcacggaggacgacctgcagaacgaggccaagatcaccgacatcatggagccggagcacgccctgctcgccacctccatcttcaagctgacctaccagaacaaggtggtgcgcgtccagcgccccgcgaagaacggcacggtgatggacgtgatcagccggcgcgaccagcgggggtccggccaggtcggcacctacgggctgaacaccttcaccaacatggaggtgcagctcatccgccagatggagagcgagggcatcttcctgccctccgagctggagacgcccaacctcgccgagcgggtgctggactggctggagaagcacggggccgagcgcctcaagcggatggccatcagcggcgacgactgcgtcgtgaagccgatcgacgaccgcttcgccaccgcgctgaccgccctgaacgacatggggaaggtgcggaaggacatcccccagtgggagccctccaagggctggaacgactggcagcaggtccccttctgcagccaccacttccaccagctcatcatgaaggacggccgcgagatcgtggtgccgtgccggaaccaggacgagctggtcgggcgcgcccgggtgtcccagggcgccgggtggagcctgcgcgagaccgcctgcctcggcaagtcctacgcgcagatgtggcagctgatgtacttccaccggcgcgacctgcggctcgccgccaacgccatctgcagcgcggtgcccgtcgactgggtgcccaccagccgcacgacctggtccatccacgcccaccaccagtggatgaccaccgaggacatgctgagcgtgtggaaccgggtctggatcgaggagaacccctggatggaggacaagacgcacgtgtccagctgggaggaggtgccgtacctggggaagcgcgaggaccagtggtgcggctccctcatcggcctgaccgcccgcgccacctgggccaccaacatccaggtcgcgatcaaccaggtgcggcgcctgatcgggaacgagaactacctcgactacatgacgagcatgaagcggttcaagaacgagtccgaccccgagggcgccctgtggtga

SEQ ID NO: 8156 - RNA, 9879 nt, synthetic construct
  misc_feature 1..9879: note = derived and/or modified CDS sequence (opt1) from DENV-1__FJ898437__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgtgaccatgctggacgtcgacctgcggccggccagcgcctggacgctctacgccgtggcgaccaccgtgatcacccccatgatgcgccacacgatcgagaacaccaccgccaacatctccctgaccgccatcgccaaccaggccgcgatcctgatgggcctcgacaagggctggcccatcagcaagatggacatcggggtccccctgctggccctcggctgctactcccaggtgaacccgctgacgctgaccgccgccgtgctcatgctggtcgcgcactacgccatcatcgggcccggcctgcaggccaaggccacccgggaggcccagaagcgcaccgcggccgggatcatgaagaaccccacggtggacggcatcgtggccatcgacctcgaccccgtcgtgtacgacgccaagttcgagaagcagctgggccagatcatgctgctcatcctgtgcaccagccagatcctgctcatgcgcaccacctgggccctgtgcgagtccatcacgctggcgaccgggccgctcaccaccctgtgggagggcagccccgggaagttctggaacacgaccatcgccgtgtccatggccaacatcttccggggcagctacctggccggcgccgggctcgcgttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtcgaccgctccgaggccaaggaggggctcaagcggggcgagaccaccaagcacgccgtgagccgcgggaccgcgaagctgcggtggttcgtggagcgcaacctggtcaagcccgagggcaaggtgatcgacctgggctgcgggcggggcgggtggtcctactactgcgccggcctcaagaaggtgaccgaggtcaaggggtacacgaagggcggccccgggcacgaggagccgatccccatggccacctacggctggaacctggtgaagctgcacagcgggaaggacgtgttcttcatgccgcccgagaagtgcgacaccctcctgtgcgacatcggcgagtccagcccgaaccccaccatcgaggaggggcgcacgctgcgggtcctcaagatggtggagccctggctgcgcggcaaccagttctgcatcaagatcctgaacccctacatgccgtccgtggtcgagaccctcgagcagatgcagcggaagcacggcgggatgctggtgcgcaaccccctgagccggaactccacccacgagatgtactgggtgagctgcggcaccgggaacatcgtctccgccgtgaacatgacgagccgcatgctcctgaaccggttcaccatggcccaccgcaagcccacctacgagcgcgacgtggacctgggcgcgggcacccggcacgtcgccgtggagcccgaggtggccaacctcgacatcatcgggcagcgcatcgagaacatcaagaacgagcacaagtccacgtggcactacgacgaggacaacccgtacaagacctgggcctaccacggcagctacgaggtcaagccctccgggagcgcctccagcatggtgaacggcgtggtccggctgctgaccaagccctgggacgtgatccccatggtcacccagatcgcgatgacggacaccaccccgttcgggcagcagcgcgtgttcaaggagaaggtggacacccggacgccccgcgccaagcggggcaccacccagatcatggaggtcaccgccaagtggctctggggcttcctgtcccgcaacaagaagccccggatctgcacgcgcgaggagttcacccggaaggtgcgcagcaacgccgccatcggggcggtgttcatcgacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggcgaagggctcccgggccatctggtacatgtggctgggcgcccgcttcctcgagttcgaggccctggggttcatgaacgaggaccactggttcagccgggagaactccctgagcggcgtcgagggggagggcctccacaagctggggtacatcctgcgcgacatctccaagatcccgggcggcaacatgtacgccgacgacaccgcggggtgggacacgcgggtgaccgaggacgacctccagaacgaggccaagatcaccgacatcatggagcccgagcacgccctgctggccaccagcatcttcaagctcacgtaccagaacaaggtggtccgcgtgcagcgccccgccaagaacggcaccgtgatggacgtcatctcccggcgcgaccagcgggggagcggccaggtgggcacctacgggctgaacaccttcacgaacatggaggtgcagctgatccgccagatggagtccgagggcatcttcctccccagcgagctggagaccccgaacctggcggagcgggtcctcgactggctggagaagcacggggccgagcgcctgcggcgcatggccatctccggcgacgactgcgtggtgaagcccatcgacgaccggttcgccaccgccctcaccgcgctgaacgacatggggaaggtccgcaaggacatcccccagtgggagcccagcaagggctggaacgactggcagcaggtcccgttctgctcccaccacttccaccagctgatcatgaaggacggccgggagatcgtggtcccctgccgcaaccaggacgagctcgtggggcgggcccgcgtgagccagggcgccgggtggtccctgcgggagaccgcctgcctgggcaagagctacgcccagatgtggcagctcatgtacttccaccgccgggacctgcgcctggcggccaacgccatctgctccgccgtccccgtggactgggtgcccacgagccggaccacctggagcatccacgcgcaccaccagtggatgaccacggaggacatgctctccgtctggaaccgcgtgtggatcgaggagaacccgtggatggaggacaagacccacgtgagctcctgggaggaggtcccctacctggggaagcgcgaggaccagtggtgcggcagcctgatcggcctcaccgcccgggccacctgggccacgaacatccaggtggccatcaaccaggtgcgccggctgatcgggaacgagaactacctggactacatgacctccatgaagcgcttcaagaacgagagcgaccccgagggcgcgctctggtga

SEQ ID NO: 8157 - RNA, 9879 nt, synthetic construct
  misc_feature 1..9879: note = derived and/or modified CDS sequence (opt1) from DENV-1__FJ024480__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctgatggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtgtccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggccatcggcatcgtgagcatcctgctctccagcctgctgaagaacgacgtccccctcgccgggccgctgatcgccggcggcatgctgatcgcctgctacgtgatcagcgggtccagcgcggacctctccctggagaaggccgccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggcggtgtccggcgtctaccccatgagcatccccgccaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgcggtggagcccgggaagaacccgaagaacgtccagaccacgcccggcaccttcaagacccccgagggcgaggtgggggccatcgccctggacttcaagcccggcaccagcgggtccccgatcgtgaaccgggagggcaagatcgtcggcctgtacgggaacggcgtggtgacgaccagcgggacctacgtctccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtgcgggaggccatcaagcgcaagctgcggaccctgatcctcgcgcccacccgcgtcgtggcctccgagatggccgaggccctgaagggcatgcccatccgctaccagaccacggccgtcaagagcgagcacaccgggcgggagatcgtcgacctgatgtgccacgcgaccttcaccatgcgcctcctgtccccggtgcgggtgcccaactacaacatgatcatcatggacgaggcccacttcacggaccccgccagcatcgccgcccgcggctacatctccacccgggtcgggatgggcgaggcggccgccatcttcatgaccgccacgccgcccgggagcgtggaggccttcccccagtccaacgcggtgatccaggacgaggagcgcgacatccccgagcggagctggaactccggctacgactggatcacggacttccccggcaagaccgtctggttcgtgcccagcatcaagtccgggaacgacatcgccaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgcggggccgatgcccgtgaccgtcgccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcgtccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgacgctccgggcgcagaacgccctggacaacctggtcatgctccacaactccgagcagggcgggaaggcctaccgccacgccatggaggagctgcccgacaccatcgagaccctgatgctcctggcgctgatcgccgtgctcaccgggggcgtgacgctgttcttcctgagcgggaagggcctcggcaagacctccatcgggctgctgtgcgtcaccgccagctccgccctcctgtggatggccagcgtggagccccactggatcgcggcctccatcatcctggagttcttcctcatggtgctgctgatcccggagcccgaccggcagcgcacgccccaggacaaccagctcgcctacgtcgtgatcggcctgctgttcatgatcctcacggtggccgccaacgagatggggctgctggagaccaccaagaaggacctcggcatcgggcacgtcgcggccgagaaccaccagcacgccaccatgctggacgtggacctgcggccggccagcgcctggacgctctacgcggtggccaccaccgtcatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtgaacccgctgacgctgaccgccgcggtcctcatgctggtggcccactacgccatcatcgggcccggcctgcaggccaaggccacccgggaggcgcagaagcgcaccgccgccgggatcatgaagaaccccacggtggacggcatcgtcgccatcgacctcgaccccgtggtgtacgacgccaagttcgagaagcagctgggccagatcatgctgctcatcctgtgcaccagccagatcctgctcatgcgcaccacctgggcgctgtgcgagtccatcacgctggccaccgggccgctcaccaccctgtgggagggcagccccgggaagttctggaacacgaccatcgccgtctccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgcggtgagccgcgggaccgccaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacacgaagggcggccccgggcacgaggagccgatccccatggccacctacggctggaacctggtgaagctgcacagcgggaaggacgtcttcttcatgccgcccgagaagtgcgacaccctcctgtgcgacatcggcgagtccagcccgaaccccaccatcgaggaggggcgcacgctgcgggtgctcaagatggtggagccctggctgcgcggcaaccagttctgcatcaagatcctgaacccctacatgccgtccgtcgtggagaccctcgagcagatgcagcggaagcacggcgggatgctggtgcgcaaccccctgagccggaactccacccacgagatgtactgggtcagctgcggcaccgggaacatcgtgtccgccgtgaacatgacgagccgcatgctcctgaaccggttcaccatggcgcaccgcaagcccacctacgagcgcgacgtcgacctgggcgccggcacccggcacgtggccgtggagcccgaggtcgccaacctcgacatcatcgggcagcgcatcgagaacatcaagaacgagcacaagtccacgtggcactacgacgaggacaacccgtacaagacctgggcctaccacggcagctacgaggtgaagccctccgggagcgcgtccagcatggtgaacggcgtcgtgaagctgctgaccaagccctgggacgtgatccccatggtcacccagatcgccatgacggacaccaccccgttcgggcagcagcgggtgttcaaggagaaggtcgacacccgcacgccccgggccaagcgcggcaccacccagatcatggaggtgaccgccaagtggctctggggcttcctgtcccggaacaagaagccccgcatctgcacgcgggaggagttcacccgcaaggtgcggagcaacgccgcgatcggggccgtcttcgtggacgagaaccagtggaacagcgccaaggaggccgtggaggacgagcgcttctgggacctggtccaccgggagcgcgagctccacaagcagggcaagtgcgcgacctgcgtgtacaacatgatggggaagcgggagaagaagctgggcgagttcgggaaggccaagggctcccgcgccatctggtacatgtggctgggcgcccggttcctcgagttcgaggccctggggttcatgaacgaggaccactggttcagccgcgagaactccctgagcggcgtggagggggagggcctccacaagctggggtacatcctgcgggacatctccaagatcccgggcggcaacatgtacgcggacgacaccgccgggtgggacacgcgcatcaccgaggacgacctccagaacgaggccaagatcaccgacatcatggagcccgagcacgccctgctggccaccagcatcttcaagctcacgtaccagaacaaggtcgtgcgggtgcagcgccccgcgaagaacggcaccgtcatggacgtgatctcccgccgggaccagcgcgggagcggccaggtgggcacctacgggctgaacaccttcacgaacatggaggtccagctgatccggcagatggagtccgagggcatcttcctccccagcgagctggagaccccgaacctggccgagcgcgtgctcgactggctggagaagcacggggccgagcggctgaagcgcatggccatctccggcgacgactgcgtggtcaagcccatcgacgaccggttcgccaccgcgctcaccgccctgaacgacatggggaaggtgcgcaaggacatcccccagtgggagcccagcaagggctggaacgactggcagcaggtcccgttctgctcccaccacttccaccagctgatcatgaaggacggccgggagatcgtcgtgccctgccgcaaccaggacgagctcgtggggcgggcccgcgtcagccagggcgccgggtggtccctgcgggagaccgcctgcctgggcaagagctacgcgcagatgtggcagctcatgtacttccaccgccgggacctgcgcctggccgccaacgccatctgctccgcggtgcccgtggactgggtccccacgagccggaccacctggagcatccacgcccaccaccagtggatgaccacggaggacatgctctccgtgtggaaccgcgtgtggatcgaggagaacccgtggatggaggacaagacccacgtcagctcctgggaggaggtgccctacctggggaagcgggaggaccagtggtgcggcagcctgatcggcctcaccgcccgcgccacctgggccacgaacatccaggtggcgatcaaccaggtccgccggctgatcgggaacgagaactacctggactacatgacctccatgaagcgcttcaagaacgagagcgaccccgagggcgccctctggtga

SEQ ID NO: 8158 - RNA, 9879 nt, synthetic construct
  misc_feature 1..9879: note = derived and/or modified CDS sequence (opt1) from DENV-1__FJ873814__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtcacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtggtggccttcttcctggcgcacgccatcggcaccagcatcacccagaaggggatcatcttcatcctcctgatgctggtcaccccctccatggccatgcgctgcgtgggcatcggcaaccgggacttcgtggaggggctcagcggcgccacgtgggtcgacgtggtgctggagcacgggtcctgcgtcaccaccatggccaagaacaagcccaccctggacatcgagctcctgaagacggaggtgaccaaccccgcgatcctgcgcaagctctgcatcgaggccaagatcagcaacaccaccacggactcccggtgcccgacccagggcgaggccaccctggtggaggagcaggacgccaacttcgtctgccgccggaccttcgtggaccgcggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgatcatcacgccccaggcccccaccagcgagatccagctgacggactacggggccctgaccctcgactgcagcccccggaccggcctggacttcaacgagatggtcctgctcaccatgaaggagaagtcctggctggtgcacaagcagtggttcctggacctcccgctgccctggacgtccggggccagcaccagccaggagacctggaaccgccaggacctgctcgtgaccttcaagacggcccacgcgaagaagcaggaggtcgtggtgctgggctcccaggagggcgccatgcacaccgccctgaccggggccaccgagatccagacgagcggcaccaccaccatcttcgccgggcacctcaagtgccggctgaagatggacaagctgacgctcaagggcacctcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctgatcacggccaacccgatcgtcaccgacaaggagaagcccgtgaacatcgagaccgagccgcccttcggggagagctacatcgtgatcggcgccggcgagaaggcgctcaagctgtcctggttcaagaaggggagctccatcggcaagatgttcgaggccaccgcccgcggggcccgccggatggccatcctgggcgacacggcgtgggacttcgggagcatcggcggcgtcttcacctccgtggggaagctcgtgcaccaggtcttcggcaccgcctacggggtgctgttcagcggcgtgtcctggaccatgaagatcgggatcggcatcctgctcacgtggctgggcctgaacagccgctccaccagcctctccatgacctgcatcgccgtcgggatggtgaccctgtacctgggcgtgatggtccaggccgacagcgggtgcgtgatcaactggaagggccgcgagctcaagtgcgggtccggcatcttcgtgacgaacgaggtccacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtggtcgtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacgaccagcgggcctggaacatctgggaggtggaggactacggcttcgggatcttcaccacgaacatctggctgaagctgcgcgactcctacacccagatgtgcgaccaccggctcatgagcgcggccatcaaggactccaaggccgtccacgccgacatgggctactggatcgagagcgagaagaacgagacctggaagctggcccgcgcgtccttcatcgaggtgaagacctgcacgtggcccaagagccacaccctgtggtccaacggcgtgctcgagagcgagatgatcatccccaagatctacgggggcccgatctcccagcacaactaccggcccgggtacttcacccagaccgccggcccctggcacctggggaagctggagctcgacttcgacctgtgcgagggcacgaccgtcgtggtggacgagcactgcggcaaccgcgggccgagcctgcggaccaccacggtcaccggcaagatcatccacgagtggtgctgccgctcctgcaccctgccgcccctgcggttccgcggggaggacggctgctggtacgggatggagatccggcccgtgaaggagaaggaggagaacctggtgcgcagcatggtctccgccggcagcggcgaggtggacagcttctccctcgggatcctgtgcgccagcatcatgatcgaggaggtgatgcggtcccgctggagccggaagatgctgatgaccggcacgctcgccgtcttcctgctgctcatcatggggcagctgacctggaacgacctgatccgcctctgcatcatggtgggcgcgaacgcctccgaccgcatggggatgggcaccacctacctggccctgatggccacgttcaagatgcggccgatgttcgccgtgggcctcctgttccgccggctgaccagccgcgaggtcctcctgctgaccatcgggctctccctggtggcgagcgtggagctgcccaactccctcgaggagctgggcgacgggctggccatgggcatcatgatgctcaagctgctgaccgagttccagccccaccagctctggacgaccctgctgagcctcaccttcatcaagaccacgctgtccctggactacgcctggaagaccaccgccatggcgctcagcatcgtctccctgttccccctgtgcctcagcaccacgtcccagaagaccacctggctgccggtgctgctcggcagcttcgggtgcaagcccctgaccatgttcctgatcaccgagaacaagatctggggccggaagtcctggcccctcaacgaggggatcatggccatcggcatcgtcagcatcctgctgtccagcctcctgaagaacgacgtgcccctggccgggccgctcatcgccggcggcatgctgatcgcctgctacgtgatcagcgggtccagcgcggacctgtccctcgagaaggccgccgaggtcagctgggagcaggaggccgagcactccggcacgagccacaacatcctggtggaggtgcaggacgacgggaccatgaagatcaaggacgaggagaaggacgacaccctgaccatcctcctgaaggccacgctgctcgcggtctccggcgtgtaccccatgagcatccccgccaccctgttcgtgtggtacttctggcagaagaagaagcagcgctccggggtcctgtgggacacccccagcccgcccgaggtggagcgggccgtgctcgacgacggcatctaccgcatcctgcagcggggcctgctggggcgctcccaggtcggcgtgggggtgttccaggacggcgtcttccacaccatgtggcacgtgacgcgcggggccgtgctcatgtaccagggcaagcgcctggagcccagctgggcctccgtcaagaaggacctgatcagctacggcgggggctggcggttccaggggtcctggaacaccggcgaggaggtccaggtgatcgcggtcgagcccgggaagaacccgaagaacgtgcagaccacccccggcacgttcaagacccccgagggcgaggtgggggccatcgccctcgacttcaagcccggcaccagcgggtccccgatcgtcaaccgcgagggcaagatcgtgggcctgtacgggaacggcgtggtcaccacgagcgggacctacgtgtccgccatcgcccaggcgaaggccagccaggagggccccctgcccgagatcgaggacgaggtgttcaagaagcggaacctcaccatcatggacctgcacccggggagcggcaagacccgccggtacctgcccgccatcgtccgcgaggccatcaagcggaagctccgcacgctgatcctggcgcccacccgggtggtggcctccgagatggccgaggccctcaagggcatgcccatccgctaccagaccaccgccgtcaagagcgagcacacggggcgcgagatcgtggacctgatgtgccacgcgaccttcaccatgcggctgctctccccggtgcgcgtccccaactacaacatgatcatcatggacgaggcccacttcaccgaccccgccagcatcgccgcccggggctacatctccacgcgcgtggggatgggcgaggcggccgccatcttcatgaccgccacgccgcccgggagcgtggaggccttcccccagtccaacgcggtcatccaggacgaggagcgggacatccccgagcgcagctggaactccggctacgactggatcaccgacttccccggcaagacggtgtggttcgtgcccagcatcaagtccgggaacgacatcgccaactgcctgcggaagaacggcaagcgcgtcatccagctgagccggaagaccttcgacaccgagtaccagaagaccaagaacaacgactgggactacgtggtgacgaccgacatctccgagatgggggccaacttccgcgccgaccgggtcatcgacccccgccggtgcctcaagcccgtgatcctgaaggacggccccgagcgcgtgatcctggcggggccgatgcccgtcaccgtggccagcgccgcccagcggcgcggccggatcggccgcaaccagaacaaggagggggaccagtacgtgtacatgggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgcgcggggaggcccggaagaccttcgtcgagctgatgcgccggggcgacctccccgtgtggctgagctacaaggtcgcgtccgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacctactccgacccgctggccctccgggagttcaaggagttcgccgccgggcgccggagcgtcagcggcgacctgatcctggagatcggcaagctcccccagcacctgaccctgcgcgcgcagaacgccctcgacaacctggtgatgctgcacaactccgagcagggcgggaaggcctaccggcacgccatggaggagctccccgacacgatcgagaccctgatgctgctcgcgctgatcgccgtgctgaccgggggcgtcaccctcttcttcctgagcgggaagggcctgggcaagacgtccatcgggctcctgtgcgtgaccgccagctccgccctgctctggatggccagcgtggagccccactggatcgcggcctccatcatcctggagttcttcctgatggtcctcctgatcccggagcccgaccgccagcggacgccccaggacaaccagctggcctacgtggtgatcggcctcctgttcatgatcctgaccgtcgccgccaacgagatggggctcctggagacgaccaagaaggacctgggcatcgggcacgtggcggccgagaaccaccagcacgccaccatgctcgacgtggacctgcgcccggccagcgcctggaccctgtacgcggtcgccacgaccgtgatcacccccatgatgcggcacaccatcgagaacacgaccgccaacatctccctcaccgccatcgccaaccaggcggccatcctgatgggcctggacaagggctggcccatcagcaagatggacatcggggtgcccctcctggccctgggctgctactcccaggtcaacccgctcaccctgacggccgcggtgctgatgctcgtggcccactacgccatcatcgggcccggcctgcaggccaaggccacccgcgaggcgcagaagcggaccgccgccgggatcatgaagaaccccaccgtcgacggcatcgtggccatcgacctggaccccgtggtctacgacgccaagttcgagaagcagctcggccagatcatgctgctgatcctctgcacgagccagatcctgctgatgcgcaccacctgggcgctctgcgagtccatcaccctggccacggggccgctgaccaccctctgggagggcagccccgggaagttctggaacaccacgatcgccgtgtccatggccaacatcttccgcggcagctacctggccggcgcggggctggccttctccctcatgaagtccctgggcgggggccggcgcgggaccggcgcccagggcgagaccctgggggagaagtggaagcggcagctcaaccagctgtccaagagcgagttcaacacctacaagcgcagcggcatcatggaggtggaccggtccgaggccaaggaggggctgaagcgcggcgagacgaccaagcacgcggtcagccgggggaccgccaagctccgctggttcgtggagcggaacctggtgaagcccgagggcaaggtcatcgacctgggctgcgggcgcggcgggtggtcctactactgcgccggcctgaagaaggtgaccgaggtgaaggggtacaccaagggcggccccgggcacgaggagagcatcccgatggccacgtacgcctggaacctcgtcaagctgcactccggcaaggacgtgttcttcatgccgcccgagaagtgcgacaccctgctctgcgacatcggggagagctcccccaacccgaccatcgaggagggccggaccctgcgcgtgctgaagatggtcgagccctggctccgggggaaccagttctgcatcaagatcctgaacccctacatgcccagcgtggtggagacgctggagcagatgcagcgcaagcacggcggcatgctcgtccggaacccgctgtcccgcaacagcacccacgagatgtactgggtgtcctgcgggaccggcaacatcgtgagcgcggtcaacatgacctcccggatgctgctcaaccgcttcacgatggcccaccggaagcccacctacgagcgcgacgtggacctgggggccggcacccgccacgtggccgtcgagcccgaggtggccaacctggacatcatcggccagcggatcgagaacatcaagaacgagcacaagagcacctggcactacgacgaggacaacccctacaagacgtgggcgtaccacgggtcctacgaggtgaagccgagcggctccgccagctccatggtcaacggggtggtgcgcctcctgaccaagccctgggacgtcatccccatggtgacccagatcgccatgaccgacacgacccccttcggccagcagcgggtcttcaaggagaaggtggacacccgcaccccgcgggccaagcgcgggacgacccagatcatggaggtgaccgccaagtggctgtggggcttcctcagccggaacaagaagccccgcatctgcacccgggaggagttcacgcgcaaggtccggagcaacgcggccatcggcgccgtgttcgtggacgagaaccagtggaactccgccaaggaggcggtcgaggacgagcgcttctgggacctggtgcaccgggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtcgagggcgaggggctgcacaagctcggctacatcctgcgggacatcagcaagatccccgggggcaacatgtacgccgacgacaccgccggctgggacacccgcatcacggaggacgacctgcagaacgaggccaagatcaccgacatcatggagccggagcacgccctcctggcgacctccatcttcaagctgacctaccagaacaaggtggtgcgggtccagcgccccgccaagaacgggacggtgatggacgtgatcagccgccgggaccagcgcggctccgggcaggtcggcacctacggcctcaacaccttcaccaacatggaggtgcagctgatccggcagatggagagcgaggggatcttcctgccctccgagctcgagacgcccaacctggccaagcgcgtgctggactggctcgagaagcacggcgccgagcggctgaagcgcatggccatcagcggggacgactgcgtcgtgaagccgatcgacgaccggttcgcgaccgccctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtggtgccgtgccgcaaccaggacgagctggtcggccgggcccgcgtgtcccagggggccggctggagcctccgggagaccgcgtgcctggggaagtcctacgcccagatgtggcagctgatgtacttccaccgccgggacctccgcctggccgccaacgcgatctgcagcgccgtgcccgtcgactgggtgcccaccagccggacgacctggtccatccacgcccaccaccagtggatgaccaccgaggacatgctgagcgtgtggaaccgcgtctggatcgaggagaacccctggatggaggacaagacgcacgtgtccagctgggaggaggtgccgtacctcggcaagcgggaggaccagtggtgcgggtccctgatcggcctgaccgcccgcgccacctgggcgaccaacatccaggtcgccatcaaccaggtgcgccggctcatcggcaacgagaactacctggactacatgacgagcatgaagcgcttcaagaacgagtccgaccccgagggggccctgtggtga

SEQ ID NO: 8159 - RNA, 9879 nt, synthetic construct
  misc_feature 1..9879: note = derived and/or modified CDS sequence (opt1) from DENV-1__JN819403__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggggagctctgcgaggacaccatgacctacaagtgcccccagatcaccgaggccgagcccgacgacgtggactgctggtgcaacgccaccgacacctgggtcacctacgggacctgcagccagaccggggagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtgggcctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcgtctccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgccggcggcatgctgatcgcctgctacgtgatcagcgggtccagcgcggacctctccctggagaaggccgccgaggtcagctgggagcaggaggccgagcactccggcaccagccacaacatcctggtggaggtgcaggacgacgggaccatgaagatcaaggacgaggagcgcgacgacaccctcacgatcctgctgaaggccaccctcctggcggtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtccgggaggccatcaagcgcaagctgcggaccctgatcctcgcgcccacccgcgtggtggcctccgagatggccgaggccctgaagggcatgcccatccgctaccagaccacggccgtcaagagcgagcacaccgggcgggagatcgtggacctgatgtgccacgcgaccttcaccatgcgcctcctgtccccggtgcgggtccccaactacaacatgatcatcatggacgaggcccacttcacggaccccgccagcatcgccgcccgcggctacatctccacccgggtggggatgggcgaggcggccgccatcttcatgaccgccacgccgcccgggagcgtggaggccttcccccagtccaacgcggtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgcggggccgatgcccgtcaccgtggccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtcgcgtccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtcagcggcgacctgatcctcgagatcggcaagctgccccagcacctgacgctccgggcgcagaacgccctggacaacctggtgatgctccacaactccgagcagggcgggaaggcctaccgccacgccatggaggagctgcccgacaccatcgagaccctgatgctcctggcgctgatcgccgtgctcaccgggggcgtcacgctgttcttcctgagcgggaagggcctcggcaagacctccatcgggctgctgtgcgtgaccgccagctccgccctcctgtggatggccagcgtggagccccactggatcgcggcctccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggcggccgagaaccaccagcacgccaccatgctggacgtggacctgcggccggccagcgcctggacgctctacgcggtcgccaccaccgtgatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtcaacccgctgacgctgaccgccgcggtgctcatgctggtggcccactacgccatcatcgggcccggcctgcaggccaaggccacccgggaggcgcagaagcgcaccgccgccgggatcatgaagaaccccacggtcgacggcatcgtggccatcgacctcgaccccgtggtctacgacaccaagttcgagaagcagctgggccagatcatgctgctcatcctgtgcaccagccagatcctgctcatgcgcaccacgtgggccctgtgcgagtccatcaccctggcgaccgggccgctcaccacgctgtgggagggcagccccgggaagttctggaacaccaccatcgccgtgtccatggccaacatcttccggggcagctacctggccggcgccgggctcgcgttctccctgatgaagtccctgggcgggggccgccgggggaccggcgcccagggcgagacgctcggggagaagtggaagcgccagctgaaccagctgtccaagagcgagttcaacacctacaagcggagcggcatcatggaggtggaccgctccgaggccaaggaggggctcaagcggggcgagaccaccaagcacgccgtcagccgcgggaccgcgaagctgcggtggttcgtggagcgcaacctggtgaagcccgagggcaaggtcatcgacctgggctgcgggcggggcgggtggtcctactactgcgccggcctcaagaaggtgacggaggtgaaggggtacaccaagggcggccccgggcacgagggcccgatccccatggccacctacgggtggaacctggtcaagctgcacagcggcaaggacgtgttcttcatgccgcccgagaagtgcgacaccctcctgtgcgacatcggggagtccagcccgaaccccacgatcgaggagggccgcaccctgcgggtgctcaagatggtcgagccctggctgcgcggcaaccagttctgcatcaagatcctgaacccctacatgccgtccgtggtggagaccctcgagcagatgcagcggaagtacgggggcatgctggtccgcaaccccctgagccggaactccacccacgagatgtactgggtgagctgcgggacgggcaacatcgtgtccgccgtcaacatgaccagccgcatgctcctgaaccggttcaccatggcccaccgcaagcccacctacgagcgcgacgtggacctgggcgcggggacgcggcacgtggccgtcgagcccgaggtggccaacctcgacatcatcggccagcgcatcgagaacatcaagaacgagcacaagtccacctggcactacgacgaggacaacccgtacaagacctgggcctaccacgggagctacgaggtgaagccctccggcagcgcctccagcatggtcaacggggtggtgcggctgctgaccaagccctgggacgtcatccccatggtgacgcagatcgcgatgaccgacaccaccccgttcggccagcagcgcgtcttcaaggagaaggtggacacgcggacgccccgggccaagcggggcaccacccagatcatggaggtgacggccaagtggctctgggggttcctgtcccgcaacaagaagccccggatctgcacccgcgaggagttcacccggaaggtccgcagcaacgccgccatcggcgcggtgttcgtggacgagaaccagtggaacagcgccaaggaggccgtcgaggacgagcggttctgggacctggtgcaccgcgagcgggagctccacaagcaggggaagtgcgcgacctgcgtgtacaacatgatgggcaagcgcgagaagaagctgggggagttcggcaaggcgaagggctcccgggccatctggtacatgtggctgggggcccgcttcctcgagttcgaggccctgggcttcatgaacgaggaccactggttcagccgggagaactccctgagcggggtcgagggcgaggggctccacaagctgggctacatcctgcgcgacatctccaagatcccgggcgggaacatgtacgccgacgacacggcgggctgggacacccggatcaccgaggacgacctccagaacgaggccaagatcaccgacatcatggagcccgagcacgccctgctggccacgagcatcttcaagctcacctaccagaacaaggtggtgcgcgtccagcgccccgccaagaacgggaccgtgatggacgtgatctcccggcgcgaccagcggggcagcggccaggtcgggacctacggcctgaacacgttcaccaacatggaggtgcagctgatccgccagatggagtccgaggggatcttcctccccagcgagctggagaccccgaacctggcggagcgggtgctcgactggctggagaagcacggcgccgagcgcctgaagcggatggccatctccggggacgactgcgtcgtgaagcccatcgacgaccgcttcgccaccgccctcaccgcgctgaacgacatgggcaaggtgcggaaggacatcccccagtgggagcccagcaagggctggaacgactggcagcaggtcccgttctgctcccaccacttccaccagctgatcatgaaggacgggcgcgagatcgtggtgccctgccggaaccaggacgagctcgtcggccgcgcccgggtgagccagggggccggctggtccctgcgcgagacggcctgcctgggcaagagctacgcccagatgtggcagctcatgtacttccaccggcgcgacctgcggctggcggccaacgccatctgctccgccgtgcccgtcgactgggtgcccaccagccgcaccacctggagcatccacgcgcaccaccagtggatgacgaccgaggacatgctctccgtgtggaaccgggtctggatcgaggagaacccgtggatggaggacaagacccacgtgagctcctgggaggaggtgccctacctgggcaagcgcgaggaccagtggtgcggcagcctgatcgggctcaccgcccgcgccacgtgggccaccaacatccaggtcgccatcaaccaggtgcggcgcctgatcggcaacgagaactacctggactacatgacctccatgaagcggttcaagaacgagagcgaccccgagggggcgctctggtga

SEQ ID NO: 8160 - RNA, 9879 nt, synthetic construct
  misc_feature 1..9879: note = derived and/or modified CDS sequence (opt1) from DENV-1__KF973453__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcatctccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggccatcggcatcgtgagcatcctgctctccagcctgctgaagaacgacgtccccctcgccgggccgctgatcgccggcggcatgctgatcgcctgctacgtgatcagcgggtccagcgcggacctctccctggagaaggccgccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggcggtgtccggcgtctaccccatgagcatccccgccaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgcggtggagcccgggaagaacccgaagaacgtccagaccacgcccggcaccttcaagacccccgagggcgaggtgggggccatcgccctggacttcaagcccggcaccagcgggtccccgatcgtgaaccgggagggcaagatcgtcggcctgtacgggaacggcgtggtgacgaccagcgggacctacgtctccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtgcgggaggccatcaagcgcaagctgcggaccctgatcctcgcgcccacccgcgtcgtggcctccgagatggccgaggccctgaagggcatgcccatccgctaccagaccacggccgtcaagagcgagcacaccgggcgggagatcgtcgacctgatgtgccacgcgaccttcaccatgcgcctcctgtccccggtgcgggtgcccaactacaacatgatcatcatggacgaggcccacttcacggaccccgccagcatcgccgcccgcggctacatctccacccgggtcgggatgggcgaggcggccgccatcttcatgaccgccacgccgcccgggagcgtggaggccttcccccagtccaacgcggtgatccaggacgaggagcgcgacatccccgagcggagctggaactccggctacgactggatcacggacttccccggcaagaccgtctggttcgtgcccagcatcaagtccgggaacgacatcgccaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgcggggccgatgcccgtgaccgtcgccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcgtccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgacgctccgggcgcagaacgccctggacaacctggtcatgctccacaactccgagcagggcgggaaggcctaccgccacgccatggaggagctgcccgacaccatcgagaccctgatgctcctggcgctgatcgccgtgctcaccgggggcgtgacgctgttcttcctgagcgggaagggcctcggcaagacctccatcgggctgctgtgcgtcaccgccagctccgccctcctgtggatggccagcgtggagccccactggatcgcggcctccatcatcctggagttcttcctcatggtgctgctgatcccggagcccgaccggcagcgcacgccccaggacaaccagctcgcctacgtcgtgatcggcctgctgttcatgatcctcacggtggccgccaacgagatggggctgctggagaccaccaagaaggacctcggcatcgggcacgtcgcggccgagaaccaccagcacgccaccatgctggacgtggacctgcggccggccagcgcctggacgctctacgcggtggccaccaccgtcatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtgaacccgctgacgctgaccgccgcggtcctcatgctggtggcccactacgccatcatcgggcccggcctgcaggccaaggccacccgggaggcgcagaagcgcaccgccgccgggatcatgaagaaccccacggtggacggcatcgtcgccatcgacctcgaccccgtggtgtacgacaccaagttcgagaagcagctgggccagatcatgctgctcatcctgtgcaccagccagatcctgctcatgcgcaccacgtgggccctgtgcgagtccatcaccctggcgaccgggccgctcaccacgctgtgggagggcagccccgggaagttctggaacaccaccatcgccgtctccatggccaacatcttccggggcagctacctggccggcgccgggctcgcgttctccctgatgaagtccctgggcgggggccgccgggggaccggcgcccagggcgagacgctcggggagaagtggaagcgccagctgaaccagctgtccaagagcgagttcaacatctacaagcggagcggcatcatggaggtggaccgctccgaggccaaggaggggctcaagcggggcgagaccaccaagcacgccgtgagccgcgggaccgcgaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacacgaagggcggccccgggcacgaggagccgatccccatggccacctacggctggaacctggtgaagctgcacagcgggaaggacgtcttcttcatgccgcccgagaagtgcgacaccctcctgtgcgacatcggcgagtccagcccgaaccccaccatcgaggaggggcgcacgctgcgggtgctcaagatggtggagccctggctgcgcggcaaccagttctgcatcaagatcctgaacccctacatgccgtccgtcgtggagaccctcgagcagatgcagcggaagtacggcgggatgctggtgcgcaaccccctgagccggaactccacccacgagatgtactgggtcagctgcggcaccgggaacatcgtgtccgccgtgaacatgacgagccgcatgctcctgaaccggttcaccatggcccaccgcaagcccacctacgagcgcgacgtcgacctgggcgcgggcacccggcacgtggccgtggagcccgaggtcgccaacctcgacatcatcgggcagcgcatcgagaacatcaagaacgagcacaagtccacgtggcactacgacgaggacaacccgtacaagacctgggcctaccacggcagctacgaggtgaagccctccgggagcgcctccagcatggtgaacggcgtcgtgcggctgctgaccaagccctgggacgtgatccccatggtcacccagatcgcgatgacggacaccaccccgttcgggcagcagcgcgtgttcaaggagaaggtcgacacccggacgccccgcgccaagcggggcaccacccagatcatggaggtgaccgccaagtggctctggggcttcctgtcccgcaacaagaagccccggatctgcacgcgcgaggagttcacccggaaggtgcgcagcaacgccgccatcggggcggtcttcgtggacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggcgaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgccgacgacaccgcggggtgggacacgcggatcaccgaggacgacctccagaacgaggccaagatcaccgacatcatggagcccgagcacgccctgctggccaccagcatcttcaagctcacgtaccagaacaaggtcgtgcgcgtgcagcgccccgccaagaacggcaccgtcatggacgtgatctcccggcgcgaccagcgggggagcggccaggtgggcacctacgggctgaacaccttcacgaacatggaggtccagctgatccgccagatggagtccgagggcatcttcctccccagcgagctggagaccccgaacctggcggagcgggtgctcgactggctggagaagcacggggccgagcgcctgaagcggatggccatctccggcgacgactgcgtggtcaagcccatcgacgaccgcttcgccaccgccctcaccgcgctgaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctcgtggggcgcgcccgggtcagccagggcgccgggtggtccctgcgcgagaccgcctgcctgggcaagagctacgcccagatgtggcagctcatgtacttccaccggcgcgacctgcggctggcggccaacgccatctgctccgccgtgcccgtggactgggtccccacgagccgcaccacctggagcatccacgcgcaccaccagtggatgaccacggaggacatgctctccgtgtggaaccgggtgtggatcgaggagaacccgtggatggaggacaagacccacgtcagctcctgggaggaggtgccctacctggggaagcgcgaggaccagtggtgcggcagcctgatcggcctcaccgcccgcgccacctgggccacgaacatccaggtggccatcaaccaggtccggcgcctgatcgggaacgagaactacctggactacatgacctccatgaagcggttcaagaacgagagcgaccccgagggcgcgctctggtga

SEQ ID NO: 8161 - RNA, 9879 nt, synthetic construct
  misc_feature 1..9879: note = derived and/or modified CDS sequence (opt1) from DENV-1__KF973454__SS-prME
  source 1..9879: mol_type = other RNA
agcgtgaccatgctcctcatgctcctgcccaccgccctcgccttccacctgaccacccggggcggggagccgcacatgatcgtgagcaagcacgagcggggcaagagcctcctgttcaagacctccaccggggtgaacatgtgcaccctgatcgccatggacctgggcgagctctgcgaggacaccatgacctacaagtgcccccgcatcaccgaggccgagcccgacgacgtggactgctggtgcaacgccacggacacctgggtgacctacgggacctgcagccagacgggcgagcaccggcgcgacaagcggtccgtggccctggcgccccacgtgggcctggggctcgagacccgcaccgagacctggatgagctccgagggcgcgtggaagcagatccagcgggtggagacgtgggccctgcgccaccccgggttcaccgtgatcgccctgttcctcgcccacgcgatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgccgtgctccggaagctgtgcatcgaggcgaagatcagcaacaccacgaccgactcccgctgcccgacccagggcgaggccaccctggtggaggagcaggacgccaacttcgtctgccggcgcacgctcgtggaccggggctgggggaacggctgcgggctgttcggcaaggggagcctgctgacctgcgccaagttcaagtgcgtgaccaagctggagggcaagatcgtccagtacgagaacctgaagtactccgtgatcgtgaccgtccacacgggcgaccagcaccaggtggggaacgagaccaccgagcacggcaccatcgccaccatcacgccccaggcgcccaccagcgagatccagctcaccgactacggggccctggccctggactgcagcccccggaccggcctcgacttcaacgagatggtcctgctgacgatgaaggagaagtcctggctcgtgcacaagcagtggttcctggacctgccgctcccctggacctccggggccagcaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcacctcctacgtcatgtgcaccgggagcttcaagctggagaaggaggtggcggagacgcagcacggcaccgtgctcgtccaggtgaagtacgagggcaccgacgccccctgcaagatccccttctccacccaggacgagaagggggtgacgcagaacggccggctgatcaccgccaacccgatcgtcaccgacaaggagaagcccgtgaacatcgagaccgagccgcccttcggggagagctacatcgtggtcggcgccggcgagaaggcgctgaagctctcctggttcaagaaggggagctccatcggcaagatgttcgaggccacggcccgcggggcccggcgcatggccatcctgggcgacaccgcgtgggacttcgggagcatcggcggcgtgttcacctccgtggggaagctggtccaccaggtgttcggcaccgcctacggggtcctcttcagcggcgtctcctggacgatgaagatcgggatcggcatcctgctgacctggctcggcctgaacagccgctccaccagcctgtccatgacctgcatcgccgtggggatggtgacgctctacctgggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctcagcgcggccatcggcaaggcctgggaggagggggtgtgcggcatccggtccgccacccgcctggagaacatcatgtggaagcagatcagcaacgagctgaaccacatcctcctggagaacgacatgaagttcacggtcgtggtgggggacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacgaccagcgcgcctggaacatctgggaggtcgaggactacggcttcgggatcttcacgaccaacatctggctcaagctgcgggactcctacacccagatgtgcgaccaccgcctgatgagcgcggccatcaaggactccaaggccgtgcacgccgacatgggctactggatcgagagcgagaagaacgagacctggaagctcgcccgggcgtccttcatcgaggtgaagacgtgcacctggcccaagagccacaccctgtggtccaacggcgtcctggagagcgagatgatcatccccaagatctacgggggcccgatctcccagcacaactaccgccccgggtacttcacccagacggccggcccctggcacctcgggaagctggagctggacttcgacctctgcgagggcaccaccgtggtggtcgacgagcactgcggcaaccgggggccgagcctgcgcaccacgaccgtgaccggcaagatcatccacgagtggtgctgccggtcctgcaccctgccgcccctccgcttccgcggggaggacggctgctggtacgggatggagatccgccccgtgaaggagaaggaggagaacctggtccggagcatggtgtccgccggcagcggcgaggtggacagcttctccctggggatcctctgcgtcagcatcatgatcgaggaggtgatgcgctcccggtggagccgcaagatgctgatgacgggcaccctggccgtgttcctcctgctgatcatggggcagctcacctggaacgacctgatccgcctgtgcatcatggtcggcgccaacgcgtccgaccggatggggatgggcaccacgtacctcgccctgatggccaccttcaagctgcgcccgatgttcgccgtgggcatcctcttccggcgcctgaccagccgggaggtgctgctcctgaccatcgggctgtccctcgtcgccagcgtggagctgcccaactccctggaggagctcggcgacgggctggcgatgggcatcatgatgctgaagctcctgacggagttccagccccaccagctgtggaccaccctcctgagcctgaccttcatcaagacgaccctctccctggactacgcctggaagaccaccgccatggccctgagcatcgtctccctcttccccatctgcctgagcacgacctcccagaagaccacctggctgccggtgctcctgggcagcttcgggtgcaagcccctgaccatgtacctcatcacggagaacaagatctggggccgcaagtcctggcccatcaacgaggggatcatggcgatcggcatcgtgagcatcctgctgtccagcctcctgaagaacgacgtccccctggccgggccgctcatcgccggcggcatgctgatcgcctgctacgtgatcagcgggtccagcgccgacctgtccctcgagaaggcggccgaggtgagctgggagcaggaggccgagcactccggcaccagccacaacatcctggtcgaggtgcaggacgacgggaccatgcggatcaaggacgaggagaaggacgacaccctgacgatcctcctgaaggccaccctgctcgccgtgtccggcgtctaccccatgagcatccccgcgaccctgttcgtgtggtacttctggcagaagaagaagcagcgctccggggtgctgtgggacacccccagcccgcccgaggtcgagcgggccgtgctcgacgacggcatctaccgcatcctgcagcggggcctgctggggcgctcccaggtgggcgtcggggtgttccaggacggcgtgttccacacgatgtggcacgtcacccgcggggccgtgctcatgtaccagggcaagcgcctggagcccagctgggcctccgtgaagaaggacctgatcagctacggcgggggctggcggttccaggggtcctggaacaccggcgaggaggtccaggtgatcgccgtggagcccgggaagaacccgaagaacgtccagaccacgcccggcaccttcaagacccccgagggcgaggtgggggcgatcgccctcgacttcaagcccggcaccagcgggtccccgatcgtgaaccgcgagggcaagatcgtcggcctgtacgggaacggcgtggtgacgaccagcgggacctacgtctccgccatcgcccaggccaaggcgagccaggagggccccctgcccgagatcgaggacgaggtgttcaagaagcggaacctcaccatcatggacctgcacccggggagcggcaagacgcgccggtacctgcccgccatcgtgcgcgaggccatcaagcggaagctccgcaccctgatcctggcccccacccgcgtcgtggcgtccgagatggccgaggccctcaagggcatgcccatccggtaccagaccacggccgtcaagagcgagcacaccgggcgcgagatcgtcgacctgatgtgccacgccaccttcaccatgcggctgctctccccggtgcgcgtgcccaactacaacatgatcatcatggacgaggcgcacttcacggaccccgccagcatcgccgcccggggctacatctccacccgcgtcgggatgggcgaggccgcggccatcttcatgaccgccacgccgcccgggagcgtggaggccttcccccagtccaacgccgtgatccaggacgaggagcgggacatccccgagcgcagctggaactccggctacgactggatcacggacttccccggcaagaccgtctggttcgtgcccagcatcaagtccgggaacgacatcgcgaactgcctgcggaagaacggcaagcgcgtgatccagctgagccggaagaccttcgacaccgagtaccagaagacgaagaacaacgactgggactacgtcgtgaccaccgacatctccgagatgggggccaacttccgcgccgaccgggtgatcgacccccgccggtgcctcaagcccgtcatcctgaaggacggccccgagcgcgtgatcctggccgggccgatgcccgtgaccgtcgcgagcgccgcccagcggcgcggccggatcggccgcaaccagaacaaggagggggaccagtacgtgtacatgggccagcccctcaacaacgacgaggaccacgcccactggacggaggccaagatgctgctggacaacatcaacacccccgaggggatcatcccggccctcttcgagcccgagcgcgagaagtccgccgccatcgacggcgagtaccggctgcgcggggaggcccggaagaccttcgtcgagctgatgcgccggggcgacctccccgtgtggctgagctacaaggtggcctccgagggcttccagtacagcgaccgccggtggtgcttcgacggggagcgcaacaaccaggtcctggaggagaacatggacgtggagatctggaccaaggagggcgagcggaagaagctccgcccccggtggctggacgcgcgcacctactccgacccgctggccctccgggagttcaaggagttcgccgccgggcgccggagcgtgagcggcgacctgatcctggagatcggcaagctcccccagcacctgacgctgcgcgcccagtccgcgctcgacaacctggtcatgctgcacaacagcgagcagggcgggaaggcctaccggcacgccatggaggagctccccgacaccatcgagaccctgatgctgctcgccctgatcgcggtgctgaccgggggcgtgatgctgttcttcctgtccgggaagggcctgggcaagacgagcatcgggctcctgtgcgtcaccgcctccagcgccctgctctggatggcctccgtggagccccactggatcgccgcgagcatcatcctggagttcttcctgatggtgctcctgatcccggagcccgaccgccagcggacgccccaggacaaccagctggcctacgtcgtgatcggcctcctgttcatgatcctgaccgtggccgccaacgagatggggctcctggagacgaccaagcgcgacctgggcatcgggcacgtcgccgcggagaaccaccagcacgccaccatgctcgacgtggacctgcggccggcctccgcctggaccctgtacgccgtggcgacgaccgtcatcacccccatgatgcgccacaccatcgagaacacgaccgccaacatcagcctcaccgccatcgccaaccaggccgcgatcctgatgggcctggacaagggctggcccatctccaagatggacatcggggtgcccctcctggccctgggctgctacagccaggtgaacccgctcaccctgacggccgccgtcctgatgctcgtggcgcactacgccatcatcgggcccggcctgcaggccaaggccacccgcgaggcccagaagcggaccgcggccgggatcatgaagaaccccaccgtggacggcatcgtcgccatcgacctggaccccgtggtgtacgacgccaagttcgagaagcagctcggccagatcatgctgctgatcctctgcacgtcccagatcctgctgatgcgcaccacctgggccctctgcgagagcatcaccctggcgacggggccgctgaccaccctctgggagggctcccccgggaagttctggaacaccacgatcgccgtcagcatggccaacatcttccggggctcctacctggccggcgccgggctggcgttcagcctcatgaagtccctgggcgggggccgccgggggaccggcgcccagggcgagaccctgggggagaagtggaagcgccagctcaaccagctgagcaagcccgagttcaacacctacaagcggagcggcatcatggaggtggaccgctccgaggccaaggaggggctgaagcggggcgagacgaccaagcacgccgtgagccgcgggaccgcgaagctccggtggttcgtcgagcgcaacctggtgaagcccgagggcaaggtgatcgacctgggctgcgggcggggcgggtggtcctactactgcgccggcctgaagaaggtcaccgaggtgaaggggtacaccaagggcggcccggggcacgaggagcccatccccatggccacgtacggctggaacctcgtgaagctgcacagcgggaaggacgtcttcttcatgcccccggagaagtgcgacaccctgctctgcgacatcggcgagtccagccccaaccccaccatcgaggaggggcgcaccctgcgggtgctgaagatggtggagccctggctccgcggcaaccagttctgcatcaagatcctgaacccgtacatgccctccgtcgtggagacgctggagcagatgcagcggaagcacggcgggatgctcgtgcgcaaccccctgagccggaactccacccacgagatgtactgggtcagctgcggcaccgggaacatcgtgtccgccgtgaacatgaccagccgcatgctgctcaaccgcttcacgatggcccaccggaagcccacctacgagcgcgacgtcgacctgggcgcgggcacccggcacgtgaccgtggagccggaggtcgccaacctggacatcatcgggcagcgcatcgagaacatcaagaacgagcacaagtccacgtggcactacgacgaggacaacccctacaagacctgggcctaccacggcagctacgaggtgaagccctccgggagcgcctccagcatggtgaacggcgtcgtgcggctcctgaccaagccctgggacgtcatcccgatggtgacccagatcgccatgacggacaccacccccttcgggcagcagcgcgtgttcaaggagaaggtcgacacccggacgccccgcgcgaagcggggcaccacccagatcatggaggtgaccgccaagtggctgtggggcttcctctcccgcaacaagaagccgcggatctgcacgcgcgaggagttcacccggaaggtgcgcagcaacgccgccatcggggccgtcttcgtggacgagaaccagtggaacagcgcgaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggctcccgggcgatctggtacatgtggctgggcgcccgcttcctggagttcgaggccctcgggttcatgaacgaggaccactggttcagccgggagaactccctgagcggcgtggagggggagggcctgcacaagctcgggtacatcctgcgcgacatctccaagatccccggcggcaacatgtacgccgacgacaccgccgggtgggacacgcgcatcaccgaggacgacctgcagaacgaggcgaagatcaccgacatcatggagcccgagcacgccctcctggccaccagcatcttcaagctgacgtaccagaacaaggtcgtgcgggtgcagcgccccgccaagaacggcaccgtcatggacgtgatctcccggcgcgaccagcgggggagcggccaggtgggcacctacgggctcaacaccttcacgaacatggaggtccagctgatccgccagatggagtccgagggcatcttcctgccgagcgagctcgagacccccaacctggccgagcgggtgctggactggctcgagaagcacggggcggagcgcctgaagcggatggccatctccggcgacgactgcgtggtcaagcccatcgacgaccgcttcgccaccgccctgaccgccctcaacgacatggggaaggtgcggaaggacatcccccagtgggagccgagcaagggctggaacgactggcagcaggtccccttctgctcccaccacttccaccagctgatcatgaaggacggccgcgagatcgtcgtgccctgccggaaccaggacgagctggtggggcgcgcgcgggtcagccagggcgccgggtggtccctccgcgagaccgcctgcctgggcaagagctacgcccagatgtggcagctgatgtacttccaccggcgcgacctccggctggccgcgaacgccatctgctccgccgtgcccgtggactgggtcccgacgagccgcaccacctggagcatccacgcccaccaccagtggatgaccacggaggacatgctgtccgtgtggaaccgcgtgtggatcgaggagaacccctggatggaggacaagacccacgtcagctcctgggaggaggtgccctacctcgggaagcgggaggaccagtggtgcggcagcctgatcggcctgaccgcgcgcgccacctgggccacgaacatccaggtggccatcaaccaggtccggcgcctcatcgggaacgagaactacctggactacatgacctccatgaagcggttcaagaacgagagcgaccccgagggcgtgctgtggtga

SEQ ID NO: 8162 - RNA, 9879 nt, synthetic construct
  misc_feature 1..9879: note = derived and/or modified CDS sequence (opt1) from DENV-1__KF973455__SS-prME
  source 1..9879: mol_type = other RNA
agcgtgaccatgctcctcatgctcctgcccaccgccctcgccttccacctgaccacccggggcggggagccgcacatgatcgtgagcaagcacgagcggggcaagagcctcctgttcaagaccagcaccggggtgaacatgtgcaccctgatcgccatggacctgggcgagctctgcgaggacaccatgacctacaagtgcccccgcatcaccgaggccgagcccgacgacgtggactgctggtgcaacgccacggacacctgggtgacctacgggacctgcagccagacgggcgagcaccggcgcgacaagcggtccgtggccctggcgccccacgtgggcctggggctcgagacccgcaccgagacctggatgagctccgagggcgcgtggaagcagatccagcgggtggagacgtgggccctgcgccaccccgggttcaccgtgatcgccctgttcctcgcccacgcgatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgccgtgctccggaagctgtgcatcgaggcgaagatcagcaacaccacgaccgactcccgctgcccgacccagggcgaggccaccctggtggaggagcaggacgccaacttcgtctgccggcgcacgctcgtggaccggggctgggggaacggctgcgggctgttcggcaaggggagcctgctgacctgcgccaagttcaagtgcgtgaccaagctggagggcaagatcgtccagtacgagaacctgaagtactccgtgatcgtgaccgtccacacgggcgaccagcaccaggtggggaacgagaccaccgagcacggcaccatcgccaccatcacgccccaggcgcccaccagcgagatccagctcaccgactacggggccctggccctggactgcagcccccggaccggcctcgacttcaacgagatggtcctgctgacgatgaaggagaagtcctggctcgtgcacaagcagtggttcctggacctgccgctcccctggacctccggggccagcaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcacctcctacgtcatgtgcaccgggagcttcaagctggagaaggaggtggcggagacgcagcacggcaccgtgctcgtccaggtgaagtacgagggcaccgacgccccctgcaagatccccttctccacccaggacgagaagggggtgacgcagaacggccggctgatcaccgccaacccgatcgtcaccgacaaggagaagcccgtgaacatcgagaccgagccgcccttcggggagagctacatcgtggtcggcgccggcgagaaggcgctgaagctctcctggttcaagaaggggagctccatcggcaagatgttcgaggccacggcccgcggggcccggcgcatggccatcctgggcgacaccgcgtgggacttcgggagcatcggcggcgtgttcacctccgtggggaagctggtccaccaggtgttcggcaccgcctacggggtcctcttcagcggcgtctcctggacgatgaagatcgggatcggcatcctgctgacctggctcggcctgaacagccgctccaccagcctgtccatgacctgcatcgccgtggggatggtgacgctctacctgggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctcagcgcggccatcggcaaggcctgggaggagggggtgtgcggcatccggtccgccacccgcctggagaacatcatgtggaagcagatcagcaacgagctgaaccacatcctcctggagaacgacatgaagttcacggtcgtggtgggggacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacgaccagcgcgcctggaacatctgggaggtcgaggactacggcttcgggatcttcacgaccaacatctggctcaagctgcgggactcctacacccagatgtgcgaccaccgcctgatgagcgcggccatcaaggactccaaggccgtgcacgccgacatgggctactggatcgagagcgagaagaacgagacctggaagctcgcccgggcgtccttcatcgaggtgaagacgtgcacctggcccaagagccacaccctgtggtccaacggcgtcctggagagcgagatgatcatccccaagatctacgggggcccgatctcccagcacaactaccgccccgggtacttcacccagacggccggcccctggcacctcgggaagctggagctggacttcgacctctgcgagggcaccaccgtggtggtcgacgagcactgcggcaaccgggggccgagcctgcgcaccacgaccgtgaccggcaagatcatccacgagtggtgctgccggtcctgcaccctgccgcccctccgcttccgcggggaggacggctgctggtacgggatggagatccgccccgtgaaggagaaggaggagaacctggtccggagcatggtgtccgccggcagcggcgaggtggacagcttctccctggggatcctctgcgtcagcatcatgatcgaggaggtgatgcgctcccggtggagccgcaagatgctgatgacgggcaccctggccgtgttcctcctgctgatcatggggcagctcacctggaacgacctgatccgcctgtgcatcatggtcggcgccaacgcgtccgaccggatggggatgggcaccacgtacctcgccctgatggccaccttcaagctgcgcccgatgttcgccgtgggcatcctcttccggcgcctgaccagccgggaggtgctgctcctgaccatcgggctgtccctcgtcgccagcgtggagctgcccaactccctggaggagctcggcgacgggctggcgatgggcatcatgatgctgaagctcctgacggagttccagccccaccagctgtggaccaccctcctgagcctgaccttcatcaagacgaccctctccctggactacgcctggaagaccaccgccatggccctgagcatcgtctccctcttccccatctgcctgagcacgacctcccagaagaccacctggctgccggtgctcctgggcagcttcgggtgcaagcccctgaccatgtacctcatcacggagaacaagatctggggccgcaagtcctggcccatcaacgaggggatcatggcgatcggcatcgtgagcatcctgctgtccagcctcctgaagaacgacgtccccctggccgggccgctcatcgccggcggcatgctgatcgcctgctacgtgatcagcgggtccagcgccgacctgtccctcgagaaggcggccgaggtgagctgggagcaggaggccgagcactccggcaccagccacaacatcctggtcgaggtgcaggacgacgggaccatgcggatcaaggacgaggagaaggacgacaccctgacgatcctcctgaaggccaccctgctcgccgtgtccggcgtctaccccatgagcatccccgcgaccctgttcgtgtggtacttctggcagaagaagaagcagcgctccggggtgctgtgggacacccccagcccgcccgaggtcgagcgggccgtgctcgacgacggcatctaccgcatcctgcagcggggcctgctggggcgctcccaggtgggcgtcggggtgttccaggacggcgtgttccacacgatgtggcacgtcacccgcggggccgtgctcatgtaccagggcaagcgcctggagcccagctgggcctccgtgaagaaggacctgatcagctacggcgggggctggcggttccaggggtcctggaacaccggcgaggaggtccaggtgatcgccgtggagcccgggaagaacccgaagaacgtccagaccacgcccggcaccttcaagacccccgagggcgaggtgggggcgatcgccctcgacttcaagcccggcaccagcgggtccccgatcgtgaaccgcgagggcaagatcgtcggcctgtacgggaacggcgtggtgacgaccagcgggacctacgtctccgccatcgcccaggccaaggcgagccaggagggccccctgcccgagatcgaggacgaggtgttcaagaagcggaacctcaccatcatggacctgcacccggggagcggcaagacgcgccggtacctgcccgccatcgtgcgcgaggccatcaagcggaagctccgcaccctgatcctggcccccacccgcgtcgtggcgtccgagatggccgaggccctcaagggcatgcccatccggtaccagaccacggccgtcaagagcgagcacaccgggcgcgagatcgtcgacctgatgtgccacgccaccttcaccatgcggctgctctccccggtgcgcgtgcccaactacaacatgatcatcatggacgaggcgcacttcacggaccccgccagcatcgccgcccggggctacatctccacccgcgtcgggatgggcgaggccgcggccatcttcatgaccgccacgccgcccgggagcgtggaggccttcccccagtccaacgccgtgatccaggacgaggagcgggacatccccgagcgcagctggaactccggctacgactggatcacggacttccccggcaagaccgtctggttcgtgcccagcatcaagtccgggaacgacatcgcgaactgcctgcggaagaacggcaagcgcgtgatccagctgagccggaagaccttcgacaccgagtaccagaagacgaagaacaacgactgggactacgtcgtgaccaccgacatctccgagatgggggccaacttccgcgccgaccgggtgatcgacccccgccggtgcctcaagcccgtcatcctgaaggacggccccgagcgcgtgatcctggccgggccgatgcccgtgaccgtcgcgagcgccgcccagcggcgcggccggatcggccgcaaccagaacaaggagggggaccagtacgtgtacatgggccagcccctcaacaacgacgaggaccacgcccactggacggaggccaagatgctgctggacaacatcaacacccccgaggggatcatcccggccctcttcgagcccgagcgcgagaagtccgccgccatcgacggcgagtaccggctgcgcggggaggcccggaagaccttcgtcgagctgatgcgccggggcgacctccccgtgtggctgagctacaaggtggcctccgagggcttccagtacagcgaccgccggtggtgcttcgacggggagcgcaacaaccaggtcctggaggagaacatggacgtggagatctggaccaaggagggcgagcggaagaagctccgcccccggtggctggacgcgcgcacctactccgacccgctggccctccgggagttcaaggagttcgccgccgggcgccggagcgtgagcggcgacctgatcctggagatcggcaagctcccccagcacctgacgctgcgcgcccagaacgcgctcgacaacctggtcatgctgcacaactccgagcagggcgggaaggcctaccggcacgccatggaggagctccccgacaccatcgagaccctgatgctgctcgccctgatcgcggtgctgaccgggggcgtgatgctgttcttcctgagcgggaagggcctgggcaagacgtccatcgggctcctgtgcgtcaccgccagctccgccctgctctggatggccagcgtggagccccactggatcgccgcgtccatcatcctggagttcttcctgatggtgctcctgatcccggagcccgaccgccagcggacgccccaggacaaccagctggcctacgtcgtgatcggcctcctgttcatgatcctgaccgtggccgccaacgagatggggctcctggagacgaccaagcgcgacctgggcatcgggcacgtcgccgcggagaaccaccagcacgccaccatgctcgacgtggacctgcacccggccagcgcctggaccctgtacgccgtggcgacgaccgtcatcacccccatgatgcggcacaccatcgagaacacgaccgccaacatctccctcaccgccatcgccaaccaggccgcgatcctgatgggcctggacaagggctggcccatcagcaagatggacatcggggtgcccctcctggccctgggctgctactcccaggtgaacccgctcaccctgacggccgccgtcctgatgctcgtggcgcactacgccatcatcgggcccggcctgcaggccaaggccacccgcgaggcccagaagcgcaccgcggccgggatcatgaagaaccccaccgtggacggcatcgtcgccatcgacctggaccccgtggtgtacgacgccaagttcgagaagcagctcggccagatcatgctgctgatcctctgcacgagccagatcctgctgatgcggaccacctgggccctctgcgagtccatcaccctggcgacggggccgctgaccaccctctgggagggcagccccgggaagttctggaacaccacgatcgccgtctccatggccaacatcttccgcggcagctacctggccggcgccgggctggcgttctccctcatgaagtccctgggcgggggccggcgcgggaccggcgcccagggcgagaccctgggggagaagtggaagcggcagctcaaccagctgtccaagcccgagttcaacacctacaagcgcagcggcatcatggaggtggaccggagcgaggccaaggaggggctgaagcgcggcgagacgaccaagcacgccgtgtcccgggggaccgcgaagctccgctggttcgtcgagcggaacctggtgaagcccgagggcaaggtgatcgacctgggctgcgggcgcggcgggtggagctactactgcgccggcctgaagaaggtcaccgaggtgaaggggtacaccaagggcggcccggggcacgaggagcccatccccatggccacgtacggctggaacctcgtgaagctgcactccgggaaggacgtcttcttcatgcccccggagaagtgcgacaccctgctctgcgacatcggcgagagctcccccaaccccaccatcgaggaggggcggaccctgcgcgtgctgaagatggtggagccctggctccggggcaaccagttctgcatcaagatcctgaacccgtacatgcccagcgtcgtggagacgctggagcagatgcagcgcaagcacggcgggatgctcgtgcggaaccccctgtcccgcaacagcacccacgagatgtactgggtctcctgcggcaccgggaacatcgtgagcgccgtgaacatgacctcccggatgctgctcaaccgcttcacgatggcccaccgcaagcccacctacgagcgggacgtcgacctgggcgcgggcacccgccacgtgaccgtggagccggaggtcgccaacctggacatcatcgggcagcggatcgagaacatcaagaacgagcacaagagcacgtggcactacgacgaggacaacccctacaagacctgggcctaccacggctcctacgaggtgaagcccagcgggtccgccagctccatggtgaacggcgtcgtgcgcctcctgaccaagccctgggacgtcatcccgatggtgacccagatcgccatgacggacaccacccccttcgggcagcagcgggtgttcaaggagaaggtcgacacccgcacgccccgggcgaagcgcggcaccacccagatcatggaggtgaccgccaagtggctgtggggcttcctcagccggaacaagaagccgcgcatctgcacgcgggaggagttcacccgcaaggtgcggtccaacgccgccatcggggccgtcttcgtggacgagaaccagtggaacagcgcgaaggaggccgtggaggacgagcgcttctgggacctggtccaccgggagcgcgagctgcacaagcagggcaagtgcgcgacctgcgtgtacaacatgatggggaagcgggagaagaagctcggcgagttcgggaaggccaagggcagccgcgcgatctggtacatgtggctgggcgcccggttcctggagttcgaggccctcgggttcatgaacgaggaccactggttctcccgcgagaacagcctgtccggcgtggagggggagggcctgcacaagctcgggtacatcctgcgggacatcagcaagatccccggcggcaacatgtacgccgacgacaccgccgggtgggacacgcgcatcaccgaggacgacctgcagaacgaggcgaagatcaccgacatcatggagcccgagcacgccctcctggccacctccatcttcaagctgacgtaccagaacaaggtcgtgcgcgtgcagcggcccgccaagaacggcaccgtcatggacgtgatcagccgccgggaccagcgcgggtccggccaggtgggcacctacgggctcaacaccttcacgaacatggaggtccagctgatccggcagatggagagcgagggcatcttcctgccgtccgagctcgagacccccaacctggccgagcgcgtgctggactggctcgagaagcacggggcggagcggctgaagcgcatggccatcagcggcgacgactgcgtggtcaagcccatcgacgaccggttcgccaccgccctgaccgccctcaacgacatggggaaggtgcgcaaggacatcccccagtgggagccgtccaagggctggaacgactggcagcaggtccccttctgcagccaccacttccaccagctgatcatgaaggacggccgggagatcgtcgtgccctgccgcaaccaggacgagctggtggggcgggcgcgcgtctcccagggcgccgggtggagcctccgggagaccgcctgcctgggcaagtcctacgcccagatgtggcagctgatgtacttccaccgccgggacctccgcctggccgcgaacgccatctgcagcgccgtgcccgtggactgggtcccgacgtcccggaccacctggagcatccacgcccaccaccagtggatgaccacggaggacatgctgagcgtgtggaaccgcgtgtggatcgaggagaacccctggatggaggacaagacccacgtctccagctgggaggaggtgccctacctcgggaagcgcgaggaccagtggtgcggctccctgatcggcctgaccgcgcgggccacctgggccacgaacatccaggtggccatcaaccaggtccgccggctcatcgggaacgagaactacctggactacatgaccagcatgaagcgcttcaagaacgagtccgaccccgagggcgccctgtggtga

SEQ ID NO: 8163 - RNA, 9879 nt, synthetic construct
  misc_feature 1..9879: note = derived and/or modified CDS sequence (opt1) from DENV-1__KF973456__SS-prME
  source 1..9879: mol_type = other RNA
agcgtgaccatgctcctcatgctcctgcccaccgccctcgccttccacctgaccacccggggcggggagccgcacatgatcgtgagcaagcacgagcggggcaagagcctcctgttcaagaccagcaccggggtgaacatgtgcaccctgatcgccatggacctgggcgagctctgcgaggacaccatgacctacaagtgcccccgcatcaccgaggccgagcccgacgacgtggactgctggtgcaacgccacggacacctgggtgacctacgggacctgcagccagacgggcgagcaccggcgcgacaagcggtccgtggccctggcgccccacgtgggcctggggctcgagacccgcaccgagacctggatgagctccgagggcgcgtggaagcagatccagcgggtggagacgtgggccctgcgccaccccgggttcaccgtgatcgccctgttcctcgcccacgcgatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgccgtgctccggaagctgtgcatcgaggcgaagatcagcaacaccacgaccgactcccgctgcccgacccagggcgaggccaccctggtggaggagcaggacgccaacttcgtctgccggcgcacgctcgtggaccggggctgggggaacggctgcgggctgttcggcaaggggagcctgctgacctgcgccaagttcaagtgcgtgaccaagctggagggcaagatcgtccagtacgagaacctgaagtactccgtgatcgtgaccgtccacacgggcgaccagcaccaggtggggaacgagaccaccgagcacggcaccatcgccaccatcacgccccaggcgcccaccagcgagatccagctcaccgactacggggccctggccctggactgcagcccccggaccggcctcgacttcaacgagatggtcctgctgacgatgaaggagaagtcctggctcgtgcacaagcagtggttcctggacctgccgctcccctggacctccggggccagcaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcacctcctacgtcatgtgcaccgggagcttcaagctggagaaggaggtggcggagacgcagcacggcaccgtgctcgtccaggtgaagtacgagggcaccgacgccccctgcaagatccccttctccacccaggacgagaagggggtgacgcagaacggccggctgatcaccgccaacccgatcgtcaccgacaaggagaagcccgtgaacatcgagaccgagccgcccttcggggagagctacatcgtggtcggcgccggcgagaaggcgctgaagctctcctggttcaagaaggggagctccatcggcaagatgttcgaggccacggcccgcggggcccggcgcatggccatcctgggcgacaccgcgtgggacttcgggagcatcggcggcgtgttcacctccgtggggaagctggtccaccaggtgttcggcaccgcctacggggtcctcttcagcggcgtctcctggacgatgaagatcgggatcggcatcctgctgacctggctcggcctgaacagccgctccaccagcctgtccatgacctgcatcgccgtggggatggtgacgctctacctgggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctcagcgcggccatcggcaaggcctgggaggagggggtgtgcggcatccggtccgccacccgcctggagaacatcatgtggaagcagatcagcaacgagctgaaccacatcctcctggagaacgacatgaagttcacggtcgtggtgggggacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacgaccagcgcgcctggaacatctgggaggtcgaggactacggcttcgggatcttcacgaccaacatctggctcaagctgcgggactcctacacccagatgtgcgaccaccgcctgatgagcgcggccatcaaggactccaaggccgtgcacgccgacatgggctactggatcgagagcgagaagaacgagacctggaagctcgcccgggcgtccttcatcgaggtgaagacgtgcacctggcccaagagccacaccctgtggtccaacggcgtcctggagagcgagatgatcatccccaagatctacgggggcccgatctcccagcacaactaccgccccgggtacttcacccagacggccggcccctggcacctcgggaagctggagctggacttcgacctctgcgagggcaccaccgtggtggtcgacgagcactgcggcaaccgggggccgagcctgcgcaccacgaccgtgaccggcaagatcatccacgagtggtgctgccggtcctgcaccctgccgcccctccgcttccgcggggaggacggctgctggtacgggatggagatccgccccgtgaaggagaaggaggagaacctggtccggagcatggtgtccgccggcagcggcgaggtggacagcttctccctggggatcctctgcgtcagcatcatgatcgaggaggtgatgcgctcccggtggagccgcaagatgctgatgacgggcaccctggccgtgttcctcctgctgatcatggggcagctcacctggaacgacctgatccgcctgtgcatcatggtcggcgccaacgcgtccgaccggatggggatgggcaccacgtacctcgccctgatggccaccttcaagctgcgcccgatgttcgccgtgggcatcctcttccggcgcctgaccagccgggaggtgctgctcctgaccatcgggctgtccctcgtcgccagcgtggagctgcccaactccctggaggagctcggcgacgggctggcgatgggcatcatgatgctgaagctcctgacggagttccagccccaccagctgtggaccaccctcctgagcctgaccttcatcaagacgaccctctccctggactacgcctggaagaccaccgccatggccctgagcatcgtctccctcttccccatctgcctgagcacgacctcccagaagaccacctggctgccggtgctcctgggcagcttcgggtgcaagcccctgaccatgtacctcatcacggagaacaagatctggggccgcaagtcctggcccatcaacgaggggatcatggcgatcggcatcgtgagcatcctgctgtccagcctcctgaagaacgacgtccccctggccgggccgctcatcgccggcggcatgctgatcgcctgctacgtgatcagcgggtccagcgccgacctgtccctcgagaaggcggccgaggtgagctgggagcaggaggccgagcactccggcaccagccacaacatcctggtcgaggtgcaggacgacgggaccatgcggatcaaggacgaggagaaggacgacaccctgacgatcctcctgaaggccaccctgctcgccgtgtccggcgtctaccccatgagcatccccgcgaccctgttcgtgtggtacttctggcagaagaagaagcagcgctccggggtgctgtgggacacccccagcccgcccgaggtcgagcgggccgtgctcgacgacggcatctaccgcatcctgcagcggggcctgctggggcgctcccaggtgggcgtcggggtgttccaggacggcgtgttccacacgatgtggcacgtcacccgcggggccgtgctcatgtaccagggcaagcgcctggagcccagctgggcctccgtgaagaaggacctgatcagctacggcgggggctggcggttccaggggtcctggaacaccggcgaggaggtccaggtgatcgccgtggagcccgggaagaacccgaagaacgtccagaccacgcccggcaccttcaagacccccgagggcgaggtgggggcgatcgccctcgacttcaagcccggcaccagcgggtccccgatcgtgaaccgcgagggcaagatcgtcggcctgtacgggaacggcgtggtgacgaccagcgggacctacgtctccgccatcgcccaggccaaggcgagccaggagggccccctgcccgagatcgaggacgaggtgttcaagaagcggaacctcaccatcatggacctgcacccggggagcggcaagacgcgccggtacctgcccgccatcgtgcgcgaggccatcaagcggaagctccgcaccctgatcctggcccccacccgcgtcgtggcgtccgagatggccgaggccctcaagggcatgcccatccggtaccagaccacggccgtcaagagcgagcacaccgggcgcgagatcgtcgacctgatgtgccacgccaccttcaccatgcggctgctctccccggtgcgcgtgcccaactacaacatgatcatcatggacgaggcgcacttcacggaccccgccagcatcgccgcccggggctacatctccacccgcgtcgggatgggcgaggccgcggccatcttcatgaccgccacgccgcccgggagcgtggaggccttcccccagtccaacgccgtgatccaggacgaggagcgggacatccccgagcgcagctggaactccggctacgactggatcacggacttccccggcaagaccgtctggttcgtgcccagcatcaagtccgggaacgacatcgcgaactgcctgcggaagaacggcaagcgcgtgatccagctgagccggaagaccttcgacaccgagtaccagaagacgaagaacaacgactgggactacgtcgtgaccaccgacatctccgagatgggggccaacttccgcgccgaccgggtgatcgacccccgccggtgcctcaagcccgtcatcctgaaggacggccccgagcgcgtgatcctggccgggccgatgcccgtgaccgtcgcgagcgccgcccagcggcgcggccggatcggccgcaaccagaacaaggagggggaccagtacgtgtacatgggccagcccctcaacaacgacgaggaccacgcccactggacggaggccaagatgctgctggacaacatcaacacccccgaggggatcatcccggccctcttcgagcccgagcgcgagaagtccgccgccatcgacggcgagtaccggctgcgcggggaggcccggaagaccttcgtcgagctgatgcgccggggcgacctccccgtgtggctgagctacaaggtggcctccgagggcttccagtacagcgaccgccggtggtgcttcgacggggagcgcaacaaccaggtcctggaggagaacatggacgtggagatctggaccaaggagggcgagcggaagaagctccgcccccggtggctggacgcgcgcacctactccgacccgctggccctccgggagttcaaggagttcgccgccgggcgccggagcgtgagcggcgacctgatcctggagatcggcaagctcccccagcacctgacgctgcgcgcccagaacgcgctcgacaacctggtcatgctgcacaactccgagcagggcgggaaggcctaccggcacgccatggaggagctccccgacaccatcgagaccctgatgctgctcgccctgatcgcggtgctgaccgggggcgtgatgctgttcttcctgagcgggaagggcctgggcaagacgtccatcgggctcctgtgcgtcaccgccagctccgccctgctctggatggccagcgtggagccccactggatcgccgcgtccatcatcctggagttcttcctgatggtgctcctgatcccggagcccgaccgccagcggacgccccaggacaaccagctggcctacgtcgtgatcggcctcctgttcatgatcctgaccgtggccgccaacgagatggggctcctggagacgaccaagcgcgacctgggcatcgggcacgtcgccgcggagaaccaccagcacgccaccatgctcgacgtggacctgcggccggccagcgcctggaccctgtacgccgtggcgacgaccgtcatcacccccatgatgcgccacaccatcgagaacacgaccgccaacatctccctcaccgccatcgccaaccaggccgcgatcctgatgggcctggacaagggctggcccatcagcaagatggacatcggggtgcccctcctggccctgggctgctactcccaggtgaacccgctcaccctgacggccgccgtcctgatgctcgtggcgcactacgccatcatcgggcccggcctgcaggccaaggccacccgcgaggcccagaagcggaccgcggccgggatcatgaagaaccccaccgtggacggcatcgtcgccatcgacctggaccccgtggtgtacgacgccaagttcgagaagcagctcggccagatcatgctgctgatcctctgcacgagccagatcctgctgatgcgcaccacctgggccctctgcgagtccatcaccctggcgacggggccgctgaccaccctctgggagggcagccccgggaagttctggaacaccacgatcgccgtctccatggccaacatcttccggggcagctacctggccggcgccgggctggcgttctccctcatgaagtccctgggcgggggccgccgggggaccggcgcccagggcgagaccctgggggagaagtggaagcgccagctcaaccagctgtccaagcccgagttcaacacctacaagcggagcggcatcatggaggtggaccgcagcgaggccaaggaggggctgaagcggggcgagacgaccaagcacgccgtgtcccgcgggaccgcgaagctccggtggttcgtcgagcgcaacctggtgaagcccgagggcaaggtgatcgacctgggctgcgggcggggcgggtggagctactactgcgccggcctgaagaaggtcaccgaggtgaaggggtacaccaagggcggcccggggcacgaggagcccatccccatggccacgtacggctggaacctcgtgaagctgcactccgggaaggacgtcttcttcatgcccccggagaagtgcgacaccctgctctgcgacatcggcgagagctcccccaaccccaccatcgaggaggggcgcaccctgcgggtgctgaagatggtggagccctggctccgcggcaaccagttctgcatcaagatcctgaacccgtacatgcccagcgtcgtggagacgctggagcagatgcagcggaagcacggcgggatgctcgtgcgcaaccccctgtcccggaacagcacccacgagatgtactgggtctcctgcggcaccgggaacatcgtgagcgccgtgaacatgacctcccgcatgctgctcaaccgcttcacgatggcccaccggaagcccacctacgagcgcgacgtcgacctgggcgcgggcacccggcacgtgaccgtggagccggaggtcgccaacctggacatcatcgggcagcgcatcgagaacatcaagaacgagcacaagagcacgtggcactacgacgaggacaacccctacaagacctgggcctaccacggctcctacgaggtgaagcccagcgggtccgccagctccatggtgaacggcgtcgtgcggctcctgaccaagccctgggacgtcatcccgatggtgacccagatcgccatgacggacaccacccccttcgggcagcagcgcgtgttcaaggagaaggtcgacacccggacgccccgcgcgaagcggggcaccacccagatcatggaggtgaccgccaagtggctgtggggcttcctcagccgcaacaagaagccgcggatctgcacgcgcgaggagttcacccggaaggtgcgctccaacgccgccatcggggccgtcttcgtggacgagaaccagtggaacagcgcgaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggcagccgggcgatctggtacatgtggctgggcgcccgcttcctggagttcgaggccctcgggttcatgaacgaggaccactggttctcccgggagaacagcctgtccggcgtggagggggagggcctgcacaagctcgggtacatcctgcgcgacatcagcaagatccccggcggcaacatgtacgccgacgacaccgccgggtgggacacgcgcatcaccgaggacgacctgcagaacgaggcgaagatcaccgacatcatggagcccgagcacgccctcctggccacctccatcttcaagctgacgtaccagaacaaggtcgtgcgggtgcagcgccccgccaagaacggcaccgtcatggacgtgatcagccggcgcgaccagcgggggtccggccaggtgggcacctacgggctcaacaccttcacgaacatggaggtccagctgatccgccagatggagagcgagggcatcttcctgccgtccgagctcgagacccccaacctggccgagcgggtgctggactggctcgagaagcacggggcggagcgcctgaagcggatggccatcagcggcgacgactgcgtggtcaagcccatcgacgaccgcttcgccaccgccctgaccgccctcaacgacatggggaaggtgcggaaggacatcccccagtgggagccgtccaagggctggaacgactggcagcaggtccccttctgcagccaccacttccaccagctgatcatgaaggacggccgcgagatcgtcgtgccctgccggaaccaggacgagctggtggggcgcgcgcgggtctcccagggcgccgggtggagcctccgcgagaccgcctgcctgggcaagtcctacgcccagatgtggcagctgatgtacttccaccggcgcgacctccggctggccgcgaacgccatctgcagcgccgtgcccgtggactgggtcccgacgtcccgcaccacctggagcatccacgcccaccaccagtggatgaccacggaggacatgctgagcgtgtggaaccgcgtgtggatcgaggagaacccctggatggaggacaagacccacgtctccagctgggaggaggtgccctacctcgggaagcgggaggaccagtggtgcggctccctgatcggcctgaccgcgcgcgccacctgggccacgaacatccaggtggccatcaaccaggtccggcgcctcatcgggaacgagaactacctggactacatgaccagcatgaagcggttcaagaacgagtccgaccccgagggcgccctgtggtga

SEQ ID NO: 8164 - RNA, 9879 nt, synthetic construct
  misc_feature 1..9879: note = derived and/or modified CDS sequence (opt1) from DENV-1__KF973459__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccctgacctacaagtgcccccagatcaccgaggccgagcccgacgacgtggactgctggtgcaacgccaccgacacgtgggtgacctacgggacctgcagccagaccggcgagcaccggcgggacaagcgctccgtggccctggcgccccacgtgggcctcgggctggagacgcggaccgagacctggatgagctccgagggcgcctggaagcagatccagcgcgtggagacctgggccctgcggcaccccgggttcacggtgatcgccctcttcctggcgcacgccatcggcaccagcatcacccagaaggggatcatcttcatcctgctcatgctggtgaccccctccatggccatgcgctgcgtgggcatcggcaaccgggacttcgtggaggggctgagcggcgccacgtgggtggacgtcgtgctcgagcacgggtcctgcgtgaccaccatggccaagaacaagcccaccctggacatcgagctgctcaagacggaggtcaccaaccccgcgatcctgcgcaagctgtgcatcgaggccaagatcagcaacaccaccacggactcccggtgcccgacccagggcgaggccaccctcgtggaggagcaggacgccaacttcgtgtgccgccggaccttcgtcgaccgcggctgggggaacggctgcgggctgttcggcaaggggagcctgctcacgtgcgccaagttcaagtgcgtgaccaagctggagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctcaccgactacggggccctgaccctggactgcagcccccggaccggcctcgacttcaacgagatggtgctgctgacgatgaaggagaagtcctggctcgtccacaagcagtggttcctggacctgccgctcccctggacctccggggccagcaccagccaggagacctggaaccgccaggacctgctggtgacgttcaagaccgcccacgcgaagaagcaggaggtggtcgtgctcggctcccaggagggcgccatgcacaccgccctgaccggggccacggagatccagaccagcggcaccaccacgatcttcgccgggcacctgaagtgccggctcaagatggacaagctgaccctgaagggcacctcctacgtgatgtgcaccgggagcttcaagctggagaaggaggtcgcggagacgcagcacggcaccgtgctcgtgcaggtcaagtacgagggcaccgacgccccctgcaagatccccttctccacccaggacgagaagggggtgacgcagaacggccgcctgatcaccgccaacccgatcgtgaccgacaaggagaagcccgtcaacatcgagaccgagccgcccttcggggagagctacatcgtggtgggcgccggcgagaaggcgctgaagctctcctggttcaagaaggggagctccatcggcaagatgttcgaggccacggcccgcggggcccgccggatggccatcctgggcgacaccgcgtgggacttcgggagcatcggcggcgtcttcacctccgtggggaagctggtgcaccaggtcttcggcaccgcctacggggtcctcttcagcggcgtgtcctggacgatgaagatcgggatcggcatcctgctgacctggctcggcctgaacagccgctccaccagcctgtccatgacctgcatcgccgtcgggatggtgacgctctacctgggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctcagcgcggccatcggcaaggcctgggaggagggggtgtgcggcatccgctccgccacccggctggagaacatcatgtggaagcagatcagcaacgagctgaaccacatcctcctggagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctcaagctgcgcgactcctacacccaggtctgcgaccaccggctgatgagcgcggccatcaaggactccaaggccgtgcacgccgacatgggctactggatcgagagcgagaagaacgagacctggaagctcgcccgcgcgtccttcatcgaggtgaagacgtgcacctggcccaagagccacaccctgtggtccaacggcgtcctggagagcgagatgatcatccccaagatctacgggggcccgatctcccagcacaactaccggcccgggtacttcacccagacggccggcccctggcacctcgggaagctggagctggacttcgacctctgcgagggcaccaccgtggtggtcgacgagcactgcggcaaccgcgggccgagcctgcggaccacgaccgtgaccggcaagatcatccacgagtggtgctgccgctcctgcaccctgccgcccctccggttccgcggggaggacggctgctggtacgggatggagatccggcccgtgaaggagaaggaggagaacctggtccgcagcatggtgtccgccggcagcggcgaggtggacagcctgtccctcgggatcctgtgcgccagcatcatgatcgaggaggtcatgcggtcccgctggagccggaagatgctgatgacgggcaccctcgccgtgttcctgctgctcatcatggggcagctgacctggaacgacctgatccgcctctgcatcatggtgggcgcgaacgcctccgaccgcatggggatgggcaccacgtacctggccctgatggccaccttcaagatgcggccgatgttcgccgtcggcctcctgttccgccggctgaccagccgcgaggtgctcctgctgaccatcgggctctccctggtggcgagcgtcgagctgcccaactccctcgaggagctgggcgacgggctggccatgggcatcatgatgctcaagctgctgacggagttccagccccaccagctctggaccaccctgctgagcctcaccttcatcaagacgaccctgtccctggactacgcctggaagaccaccgccatggcgctcagcatcatctccctgttccccctgtgcctcagcacgacctcccagaagaccacctggctgccggtgctgctcggcagcttcgggtgcaagcccctgaccatgttcctgatcacggagaacaagatctggggccggaagtcctggcccctcaacgaggggatcatggccatcggcatcgtcagcatcctgctgtccagcctcctgaagaacgacgtgcccctggccgggccgctcatcgccggcggcatgctgatcgcctgctacgtgatcagcgggtccagcgcggacctgtccctcgagaaggccgccgaggtcagctgggagcaggaggccgagcactccggcaccagccacaacatcctggtggaggtgcaggacgacgggaccatgaagatcaaggacgaggagcgcgacgacaccctgacgatcctcctgaaggccaccctgctcgcggtctccggcgtgtaccccatgagcatccccgccaccctgttcgtgtggtacttctggcagaagaagaagcagcggtccggggtcctgtgggacacccccagcccgcccgaggtggagcgcgccgtgctggacgacggcatctaccggatcctccagcgcggcctgctggggcggtcccaggtcggcgtgggggtgttccaggacggcgtcttccacacgatgtggcacgtgacccgcggggccgtgctcatgtaccagggcaagcggctggagcccagctgggcctccgtcaagaaggacctgatcagctacggcgggggctggcgcttccaggggtcctggaacaccggcgaggaggtccaggtgatcgcggtcgagcccgggaagaacccgaagaacgtgcagaccacgcccggcaccttcaagacccccgagggcgaggtgggggccatcgccctcgacttcaagcccggcaccagcgggtccccgatcgtcaaccgggagggcaagatcgtgggcctgtacgggaacggcgtggtcacgaccagcgggacctacgtgtccgccatcgcccaggcgaaggtgagccaggagggccccctgcccgagatcgaggacgaggtcttcaagaagcgcaacctcaccatcatggacctgcacccggggagcggcaagacgcggcgctacctgcccgccatcgtgcgggaggccatcaagcgcaagctccggaccctgatcctggcccccacccgcgtggtcgcgtccgagatggccgaggccctcaagggcatgcccatccgctaccagaccacggccgtcaagagcgagcacaccgggcgggagatcgtggacctgatgtgccacgccaccttcaccatgcgcctgctctccccggtccgggtgcccaactacaacatgatcatcatggacgaggcgcacttcacggaccccgccagcatcgccgcccgcggctacatctccacccgggtggggatgggcgaggccgcggccatcttcatgaccgccacgccgcccgggagcgtcgaggccttcccccagtccaacgccgtgatccaggacgaggagcgcgacatccccgagcggagctggaactccggctacgactggatcacggacttccccggcaagaccgtgtggttcgtccccagcatcaagtccgggaacgacatcgcgaactgcctgcgcaagaacggcaagcgggtgatccagctgagccgcaagaccttcgacaccgagtaccagaagacgaagaacaacgactgggactacgtggtcaccaccgacatctccgagatgggggccaacttccgggccgaccgcgtgatcgacccccggcgctgcctcaagcccgtgatcctgaaggacggccccgagcgggtcatcctggccgggccgatgcccgtgaccgtggcgagcgccgcccagcgccggggccgcatcggccggaaccagaacaaggagggggaccagtacgtctacatgggccagcccctcaacaacgacgaggaccacgcccactggacggaggccaagatgctgctggacaacatcaacacccccgaggggatcatcccggccctcttcgagcccgagcgcgagaagtccgcggccatcgacggcgagtaccgcctgcgcggggaggcccgcaagaccttcgtggagctgatgcggcgcggcgacctccccgtctggctgagctacaaggtggcctccgagggcttccagtacagcgaccggcgctggtgcttcgacggggagcggaacaaccaggtgctggaggagaacatggacgtcgagatctggaccaaggagggcgagcgcaagaagctccggccccgctggctggacgcgcggacctactccgacccgctggccctccgcgagttcaaggagttcgccgccgggcggcgcagcgtgagcggcgacctgatcctggagatcggcaagctcccccagcacctgacgctgcgggcccagaacgcgctcgacaacctggtgatgctgcacaactccgagcagggcgggaaggcctaccgccacgccatggaggagctccccgacaccatcgagaccctgatgctgctcgccctgatcgcggtcctgaccgggggcgtgaccctcttcttcctgagcgggaagggcctgggcaagacctccatcgggctcctgtgcgtgaccgccagctccgccctgctctggatggccagcgtcgagccccactggatcgccgcgtccatcatcctggagttcttcctgatggtgctcctgatcccggagcccgaccggcagcgcacgccccaggacaaccagctggcctacgtggtcatcggcctcctgttcatgatcctgacggtggccgccaacgagatggggctcctggagaccaccaagaaggacctgggcatcgggcacgtggccgcggagaaccaccagcacgccaccatgctcgacgtcgacctgcggccggccagcgcctggacgctgtacgccgtggcgaccaccgtgatcacccccatgatgcgccacacgatcgagaacaccaccgccaacatctccctcaccgccatcgccaaccaggccgcgatcctgatgggcctggacaagggctggcccatcagcaagatggacatcggggtccccctcctggccctgggctgctactcccaggtgaacccgctcacgctgaccgccgccgtgctgatgctcgtcgcgcactacgccatcatcgggcccggcctgcaggccaaggccacccgggaggcccagaagcgcaccgcggccgggatcatgaagaaccccacggtggacggcatcgtggccatcgacctggaccccgtcgtgtacgacaccaagttcgagaagcagctcggccagatcatgctgctgatcctctgcaccagccagatcctgctgatgcgcaccacgtgggccctctgcgagtccatcaccctggccaccgggccgctgaccacgctctgggagggcagccccgggaagttctggaacaccaccatcgcggtgtccatggccaacatcttccggggcagctacctggccggcgccgggctggccttctccctcatgaagtccctgggcgggggccgccgggggaccggcgcgcagggcgagacgctgggggagaagtggaagcgccagctcaaccagctgtccaagagcgagttcaacatctacaagcggagcggcatcatggaggtcgaccgctccgaggccaaggaggggctgaagcggggcgagaccaccaagcacgccgtgagccgcgggaccgccaagctgcggtggttcgtggagcgcaacctcgtcaagcccgagggcaaggtgatcgacctgggctgcgggcggggcgggtggtcctactactgcgcgggcctgaagaaggtgaccgaggtcaaggggtacacgaagggcggccccgggcacgaggagccgatccccatggccacctacggctggaacctcgtgaagctgcacagcgggaaggacgtgttcttcatgccgcccgagaagtgcgacaccctgctctgcgacatcggcgagtccagcccgaaccccaccatcgaggaggggcgcacgctgcgggtcctgaagatggtggagccctggctccgcggcaaccagttctgcatcaagatcctgaacccctacatgccgtccgtggtcgagaccctggagcagatgcagcggaagtacggcgggatgctcgtgcgcaaccccctgagccggaactccacccacgagatgtactgggtgagctgcggcaccgggaacatcgtctccgccgtgaacatgacgagccgcatgctgctcaaccggttcaccatggcccaccgcaagcccacctacgagcgcgacgtggacctgggcgccggcacccggcacgtcgcggtggagcccgaggtggccaacctggacatcatcgggcagcgcatcgagaacatcaagaacgagcacaagtccacgtggcactacgacgaggacaacccgtacaagacctgggcctaccacggcagctacgaggtcaagccctccgggagcgcctccagcatggtgaacggcgtggtccggctcctgaccaagccctgggacgtgatccccatggtcacccagatcgccatgacggacaccaccccgttcgggcagcagcgcgtgttcaaggagaaggtggacacccggacgccccgcgcgaagcggggcaccacccagatcatggaggtcaccgccaagtggctgtggggcttcctctcccgcaacaagaagccccggatctgcacgcgcgaggagttcacccggaaggtgcgcagcaacgccgccatcggggccgtgttcgtcgacgagaaccagtggaacagcgcgaaggaggccgtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggctcccgggcgatctggtacatgtggctgggcgcccgcttcctggagttcgaggccctcgggttcatgaacgaggaccactggttcagccgggagaactccctgagcggcgtggagggggagggcctgcacaagctcgggtacatcctgcgcgacatctccaagatcccgggcggcaacatgtacgccgacgacaccgccgggtgggacacgcggatcaccgaggacgacctgcagaacgaggcgaagatcaccgacatcatggagcccgagcacgccctcctggccaccagcatcttcaagctgacgtaccagaacaaggtggtccgcgtgcagcgccccgccaagaacggcaccgtgatggacgtcatctcccggcgcgaccagcgggggagcggccaggtgggcacctacgggctcaacaccttcacgaacatggaggtgcagctgatccgccagatggagtccgagggcatcttcctgcccagcgagctcgagaccccgaacctggccaagcgggtcctggactggctcgagaagcacggggcggagcgcctgaagcggatggccatctccggcgacgactgcgtggtgaagcccatcgacgaccgcttcgccaccgccctgaccgccctcaacgacatggggaaggtccggaaggacatcccccagtgggagcccagcaagggctggaacgactggcagcaggtcccgttctgctcccaccacttccaccagctgatcatgaaggacggccgcgagatcgtggtcccctgccggaaccaggacgagctggtggggcgcgcgcgggtgagccagggcgccgggtggtccctccgcgagaccgcctgcctgggcaagagctacgcccagatgtggcagctgatgtacttccaccggcgcgacctccggctggccgcgaacgccatctgctccgccgtccccgtggactgggtgcccacgagccgcaccacctggagcatccacgcccaccaccagtggatgaccacggaggacatgctgtccgtctggaaccgggtgtggatcgaggagaacccgtggatggaggacaagacccacgtgagctcctgggaggaggtcccctacctcgggaagcgcgaggaccagtggtgcggcagcctgatcggcctgaccgcgcgcgccacctgggccacgaacatccaggtggccatcaaccaggtgcggcgcctcatcgggaacgagaactacctggactacatgacctccatgaagcggttcaagaacgagagcgaccccgagggcgccctgtggtga

SEQ ID NO: 8165 - RNA, 9879 nt, synthetic construct
  misc_feature 1..9879: note = derived and/or modified CDS sequence (opt1) from DENV-1__KF973460__SS-prME
  source 1..9879: mol_type = other RNA
agcgtgaccatgctcctcatgctgctgcccaccgccctcgccttccacctgaccacccgcggcggggagccgcacatgatcgtgagcaagcacgagcggggcaagagcctcctgttcaagaccagcaccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagacgggcgagcaccggcgcgacaagcggtccgtggccctggcgccccacgtgggcctggggctcgagacccgcaccgagacctggatgagctccgagggcgcctggaagcagatccagcgggtggagacgtgggccctgcgccaccccgggttcaccgtgatcgccctgttcctcgcccacgcgatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgccgtgctccggaagctgtgcatcgaggcgaagatcagcaacaccacgaccgactcccgctgcccgacccagggcgaggccaccctggtggaggagcaggacgccaacttcgtctgccggcgcacgctcgtggaccggggctgggggaacggctgcgggctgttcggcaaggggagcctgctgacctgcgccaagttcaagtgcgtgaccaagctggagggcaagatcgtccagtacgagaacctgaagtactccgtgatcgtgaccgtccacacgggcgaccagcaccaggtggggaacgagaccaccgagcacggcaccatcgccaccatcacgccccaggcgcccaccagcgagatccagctcaccgactacggggccctggccctggactgcagcccccggaccggcctcgacttcaacgagatggtcctgctgacgatgaaggagaagtcctggctcgtgcacaagcagtggttcctggacctgccgctcccctggacctccggggccagcaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcacctcctacgtcatgtgcaccgggagcttcaagctggagaaggaggtggcggagacgcagcacggcaccgtgctcgtccaggtgaagtacgagggcaccgacgccccctgcaagatccccttctccacccaggacgagaagggggtgacgcagaacggccggctgatcaccgccaacccgatcgtcaccgacaaggagaagcccgtgaacatcgagaccgagccgcccttcggggagagctacatcgtggtcggcgccggcgagaaggcgctgaagctctcctggttcaagaaggggagctccatcggcaagatgttcgaggccacggcccgcggggcccggcgcatggccatcctgggcgacaccgcgtgggacttcgggagcatcggcggcgtgttcacctccgtggggaagctggtccaccaggtgttcggcaccgcctacggggtcctcttcagcggcgtctcctggacgatgaagatcgggatcggcatcctgctgacctggctcggcctgaacagccgctccaccagcctgtccatgacctgcatcgccgtggggatggtgacgctctacctgggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctcagcgcggccatcggcaaggcctgggaggagggggtgtgcggcatccggtccgccacccgcctggagaacatcatgtggaagcagatcagcaacgagctgaaccacatcctcctggagaacgacatgaagttcacggtcgtggtgggggacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacgaccagcgcgcctggaacatctgggaggtcgaggactacggcttcgggatcttcacgaccaacatctggctcaagctgcgggactcctacacccagatgtgcgaccaccgcctgatgagcgcggccatcaaggactccaaggccgtgcacgccgacatgggctactggatcgagagcgagaagaacgagacctggaagctcgcccgggcgtccttcatcgaggtgaagacgtgcacctggcccaagagccacaccctgtggtccaacggcgtcctggagagcgagatgatcatccccaagatctacgggggcccgatctcccagcacaactaccgccccgggtacttcacccagacggccggcccctggcacctcgggaagctggagctggacttcgacctctgcgagggcaccaccgtggtggtcgacgagcactgcggcaaccgggggccgagcctgcgcaccacgaccgtgaccggcaagatcatccacgagtggtgctgccggtcctgcaccctgccgcccctccgcttccgcggggaggacggctgctggtacgggatggagatccgccccgtgaaggagaaggaggagaacctggtccggagcatggtgtccgccggcagcggcgaggtggacagcctgtccctcgggatcctgtgcgtcagcatcatgatcgaggaggtgatgcgctcccggtggagccgcaagatgctgatgacgggcaccctcgccgtgttcctgctgctcatcatggggcagctgacctggaacgacctgatccgcctctgcatcatggtcggcgccaacgcgtccgaccggatggggatgggcaccacgtacctggccctgatggccaccttcaagctccgcccgatgttcgccgtgggcatcctgttccggcgcctgaccagccgggaggtgctcctgctgaccatcgggctctccctggtcgccagcgtggagctgcccaactccctcgaggagctgggcgacgggctggcgatgggcatcatgatgctcaagctgctgacggagttccagccccaccagctctggaccaccctgctgagcctcaccttcatcaagacgaccctgtccctggactacgcctggaagaccaccgccatggccctcagcatcgtctccctgttccccctgtgcctcagcacgacctcccagaagaccacctggctgccggtgctgctcggcagcttcgggtgcaagcccctgaccatgtacttcatcacggagaacaagatctggggccgcaagtcctggcccatcaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgcggatcaaggacgaggagaaggacgacaccctcacgatcctgctgaaggccaccctcctggccgtgtccggcgtctaccccatgagcatccccgcgaccctgttcgtgtggtacttctggcagaagaagaagcagcgctccggggtgctctgggacacccccagcccgcccgaggtcgagcgggccgtgctggacgacggcatctaccgcatcctgcagcggggcctgctcgggcgctcccaggtgggcgtcggggtgttccaggacggcgtgttccacacgatgtggcacgtcacccgcggggccgtgctgatgtaccagggcaagcgcctggagcccagctgggcctccgtgaagaaggacctcatcagctacggcgggggctggcggttccaggggtcctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcaccagcgggtccccgatcgtgaaccgcgagggcaagatcgtcggcctgtacgggaacggcgtggtgacgaccagcgggacctacgtctccgccatcgcccaggccaaggcgagccaggagggccccctccccgagatcgaggacgaggtgttcaagaagcggaacctgaccatcatggacctgcacccggggagcggcaagacgcgccggtacctccccgccatcgtgcgcgaggccatcaagcggaagctgcgcaccctgatcctcgcccccacccgcgtcgtggcgtccgagatggccgaggccctgaagggcatgcccatccggtaccagaccacggccgtcaagagcgagcacaccgggcgcgagatcgtcgacctgatgtgccacgccaccttcaccatgcggctcctgtccccggtgcgcgtgcccaactacaacatgatcatcatggacgaggcgcacttcacggaccccgccagcatcgccgcccggggctacatctccacccgcgtcgggatgggcgaggccgcggccatcttcatgaccgccacgccgcccgggagcgtggaggccttcccccagtccaacgccgtgatccaggacgaggagcgggacatccccgagcgcagctggaactccggctacgactggatcacggacttccccggcaagaccgtctggttcgtgcccagcatcaagtccgggaacgacatcgcgaactgcctgcggaagaacggcaagcgcgtgatccagctcagccggaagaccttcgacaccgagtaccagaagacgaagaacaacgactgggactacgtcgtgaccaccgacatctccgagatgggggccaacttccgcgccgaccgggtgatcgacccccgccggtgcctgaagcccgtcatcctgaaggacggccccgagcgcgtgatcctcgccgggccgatgcccgtgaccgtcgcgagcgccgcccagcggcgcggccggatcggccgcaaccagaacaaggagggggaccagtacgtgtacatgggccagcccctgaacaacgacgaggaccacgcccactggacggaggccaagatgctgctcgacaacatcaacacccccgaggggatcatcccggcgctgttcgagcccgagcgcgagaagtccgccgccatcgacggcgagtaccggctgcgcggggaggcccggaagaccttcgtcgagctcatgcgccggggcgacctgcccgtgtggctgagctacaaggtggcctccgagggcttccagtacagcgaccgccggtggtgcttcgacggggagcgcaacaaccaggtcctcgaggagaacatggacgtggagatctggaccaaggagggcgagcggaagaagctgcgcccccggtggctggacgcgcgcacctactccgacccgctcgccctgcgggagttcaaggagttcgccgccgggcgccggagcgtgagcggcgacctgatcctcgagatcggcaagctgccccagcacctgacgctccgcgcccagaacgcgctggacaacctggtcatgctccacaactccgagcagggcgggaaggcctaccggcacgccatggaggagctgcccgacaccatcgagaccctgatgctcctggccctgatcgcggtgctcaccgggggcgtgacgctgttcttcctgagcgggaagggcctcggcaagacctccatcgggctgctgtgcgtcaccgccagctccgccctcctgtggatggccagcgtggagccccactggatcgccgcgtccatcatcctggagttcttcctcatggtgctgctgatcccggagcccgaccgccagcggacgccccaggacaaccagctcgcctacgtcgtgatcggcctgctgttcatgatcctcacggtggccgccaacgagatggggctgctggagaccaccaagcgcgacctcggcatcgggcacgtcgccgcggagaaccaccagcacgccaccatgctggacgtggacctgcggccggccagcgcctggacgctctacgccgtggcgaccaccgtcatcacccccatgatgcgccacacgatcgagaacaccaccgccaacatctccctgaccgccatcgccaaccaggccgcgatcctgatgggcctcgacaagggctggcccatcagcaagatggacatcggggtgcccctgctggccctcggctgctactcccaggtgaacccgctgacgctgaccgccgccgtcctcatgctggtggcgcactacgccatcatcgggcccggcctgcaggccaaggccacccgcgaggcccagaagcggaccgcggccgggatcatgaagaaccccacggtggacggcatcgtcgccatcgacctcgaccccgtggtgtacgacgccaagttcgagaagcagctgggccagatcatgctgctcatcctgtgcatcagccagatcctgctcatgcgcaccacctgggccctgtgcgagtccatcaccctggcgacggggccgctcaccaccctgtgggagggcagccccgggaagttctggaacaccacgatcgccgtctccatggccaacatcttccggggcagctacctggccggcgccgggctcgcgttctccctgatgaagtccctgggcgggggccgccgggggaccggcgcccagggcgagaccctcggggagaagtggaagcgccagctgaaccagctgtccaagcccgagttcaacacctacaagcggagcggcatcatggaggtggaccgcagcgaggccaaggaggggctcaagcggggcgagacgaccaagcacgccgtgtcccgcgggaccgcgaagctgcggtggttcgtcgagcgcaacctggtgaagcccgagggcaaggtgatcgacctgggctgcgggcggggcgggtggagctactactgcgccggcctcaagaaggtcaccgaggtgaaggggtacaccaagggcggcccggggcacgaggagcccatccccatggccacgtacggctggaacctggtgaagctgcactccgggaaggacgtcttcttcatgcccccggagaagtgcgacaccctcctgtgcgacatcggcgagagctcccccaaccccaccatcgaggaggggcgcaccctgcgggtgctcaagatggtggagccctggctgcgcggcaaccagttctgcatcaagatcctgaacccgtacatgcccagcgtcgtggagacgctcgagcagatgcagcggaagcacggcgggatgctggtgcgcaaccccctgtcccggaacagcacccacgagatgtactgggtctcctgcggcaccgggaacatcgtgagcgccgtgaacatgacctcccgcatgctcctgaaccgcttcacgatggcccaccggaagcccacctacgagcgcgacgtcgacctgggcgcgggcacccggcacgtggccgtggagccggaggtcgccaacctcgacatcatcgggcagcgcatcgagaacatcaagaacgagcacaagagcacctggcactacgacgaggacaacccctacaagacgtgggcctaccacggctcctacgaggtgaagcccagcgggtccgccagctccatggtgaacggcgtcgtgcggctgctgaccaagccctgggacgtcatcccgatggtgacccagatcgcgatgaccgacacgacccccttcgggcagcagcgcgtgttcaaggagaaggtcgacacccggacgccccgggccaagcggggcacgacccagatcatggaggtgaccgccaagtggctctggggcttcctgagccgcaacaagaagccgcggatctgcacccgcgaggagttcacgcggaaggtgcgctccaacgccgccatcggggcggtcttcgtggacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggcgaagggcagccgggccatctggtacatgtggctgggcgcccgcttcctcgagttcgaggccctggggttcatgaacgaggaccactggttctcccgggagaacagcctgtccggcgtggagggggagggcctccacaagctggggtacatcctgcgcgacatcagcaagatccccggcggcaacatgtacgccgacgacaccgcggggtgggacacccgcatcacggaggacgacctccagaacgaggccaagatcaccgacatcatggagcccgagcacgccctgctggccacctccatcttcaagctcacctaccagaacaaggtcgtgcgggtgcagcgccccgccaagaacggcacggtcatggacgtgatcagccggcgcgaccagcgggggtccggccaggtgggcacctacgggctgaacaccttcaccaacatggaggtccagctgatccgccagatggagagcgagggcatcttcctcccgtccgagctggagacgcccaacctggcggagcgggtgctcgactggctggagaagcacggggccgagcgcctgaagcggatggccatcagcggcgacgactgcgtggtcaagcccatcgacgaccgcttcgccaccgccctcaccgcgctgaacgacatggggaaggtgcggaaggacatcccccagtgggagccgtccaagggctggaacgactggcagcaggtccccttctgcagccaccacttccaccagctgatcatgaaggacggccgcgagatcgtcgtgccctgccggaaccaggacgagctcgtggggcgcgcccgggtctcccagggcgccgggtggagcctgcgcgagaccgcctgcctgggcaagtcctacgcccagatgtggcagctcatgtacttccaccggcgcgacctgcggctggcggccaacgccatctgcagcgccgtgcccgtggactgggtcccgacctcccgcacgacctggagcatccacgcgcaccaccagtggatgaccaccgaggacatgctcagcgtgtggaaccgcgtgtggatcgaggagaacccctggatggaggacaagacgcacgtctccagctgggaggaggtgccctacctggggaagcgggaggaccagtggtgcggctccctgatcggcctcaccgcccgcgccacctgggccaccaacatccaggtggccatcaaccaggtccggcgcctgatcgggaacgagagctacctggactacatgacgtccatgaagcggttcaagaacgagagcgaccccgagggcgcgctctggtga

SEQ ID NO: 8166 - RNA, 9879 nt, synthetic construct
  misc_feature 1..9879: note = derived and/or modified CDS sequence (opt1) from DENV-1__KF973461__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatgggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgagctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagatcaccgccatggcgctgagcatcatctccctgttccccctctgcctgagcaccacgtcccagaagaccacctggctgccggtcctcctgggcagcttcgggtgcaagcccctgaccatgttcctcatcaccgagaacaagatctggggccggaagtcctggcccctgaacgaggggatcatggccatcggcatcgtgagcatcctgctctccagcctgctgaagaacgacgtccccctcgccgggccgctgatcgccggcggcatgctgatcgcctgctacgtgatcagcgggtccagcgcggacctctccctggagaaggccgccgaggtgagctgggagcaggaggccgagcactccggcacgagccacaacatcctggtcgaggtgcaggacgacgggaccatgaagatcaaggacgaggagcgcgacgacaccctcaccatcctgctgaaggccacgctcctggcggtgtccggcgtctaccccatgagcatccccgccaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacaccatgtggcacgtcacgcgcggggccgtgctgatgtaccagggcaagcggctggagcccagctgggcctccgtgaagaaggacctcatcagctacggcgggggctggcgcttccaggggtcctggaacaccggcgaggaggtccaggtgatcgcggtggagcccgggaagaacccgaagaacgtccagaccacccccggcacgttcaagacccccgagggcgaggtgggggccatcgccctggacttcaagcccggcaccagcgggtccccgatcgtgaaccgggagggcaagatcgtcggcctgtacgggaacggcgtggtgaccacgagcgggacctacgtctccgccatcgcccaggcgaaggccagccaggagggccccctccccgagatcgaggacgaggtgttcaagaagcgcaacctgaccatcatggacctgcacccggggagcggcaagacccggcgctacctccccgccatcgtgcgggaggccatcaagcgcaagctgcggacgctgatcctcgcgcccacccgcgtcgtggcctccgagatggccgaggccctgaagggcatgcccatccgctaccagaccaccgccgtcaagagcgagcacacggggcgggagatcgtcgacctgatgtgccacgcgaccttcaccatgcgcctcctgtccccggtgcgggtgcccaactacaacatgatcatcatggacgaggcccacttcaccgaccccgccagcatcgccgcccgcggctacatctccacgcgggtcgggatgggcgaggcggccgccatcttcatgaccgccacgccgcccgggagcgtggaggccttcccccagtccaacgcggtgatccaggacgaggagcgcgacatccccgagcggagctggaactccggctacgactggatcaccgacttccccggcaagacggtctggttcgtgcccagcatcaagtccgggaacgacatcgccaactgcctgcgcaagaacggcaagcgggtgatccagctcagccgcaagaccttcgacaccgagtaccagaagaccaagaacaacgactgggactacgtcgtgacgaccgacatctccgagatgggggccaacttccgggccgaccgcgtgatcgacccccggcgctgcctgaagcccgtcatcctgaaggacggccccgagcgggtgatcctcgcggggccgatgcccgtgaccgtcgccagcgccgcccagcgccggggccgcatcggccggaaccagaacaaggagggggaccagtacgtgtacatgggccagcccctgaacaacgacgaggaccacgcccactggaccgaggcgaagatgctgctcgacaacatcaacacgcccgaggggatcatcccggccctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcgtccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgaccctccgggcgcagaacgccctggacaacctggtcatgctccacaactccgagcagggcgggaaggcctaccgccacgccatggaggagctgcccgacacgatcgagaccctgatgctcctggcgctgatcgccgtgctcaccgggggcgtgaccctgttcttcctgagcgggaagggcctcggcaagacgtccatcgggctgctgtgcgtcaccgccagctccgccctcctgtggatggccagcgtggagccccactggatcgcggcctccatcatcctggagttcttcctcatggtgctgctgatcccggagcccgaccggcagcgcacgccccaggacaaccagctcgcctacgtcgtgatcggcctgctgttcatgatcctcaccgtggccgccaacgagatggggctgctggagacgaccaagaaggacctcggcatcgggcacgtcgcggccgagaaccaccagcacgccaccatgctggacgtggacctgcggccggccagcgcctggaccctctacgcggtggccacgaccgtcatcacccccatgatgcgccacaccatcgagaacacgaccgccaacatctccctgaccgccatcgccaaccaggcggccatcctgatgggcctcgacaagggctggcccatcagcaagatggacatcggggtgcccctgctggccctcggctgctactcccaggtgaacccgctgaccctgacggccgcggtcctcatgctggtggcccactacgccatcatcgggcccggcctgcaggccaaggccacccgggaggcgcagaagcgcaccgccgccgggatcatgaagaaccccaccgtggacggcatcgtcgccatcgacctcgaccccgtggtgtacgacacgaagttcgagaagcagctgggccagatcatgctgctcatcctgtgcaccagccagatcctgctcatgcgcaccacctgggccctgtgcgagtccatcacgctggcgaccgggccgctcaccaccctgtgggagggcagccccgggaagttctggaacacgaccatcgccgtctccatggccaacatcttccggggcagctacctggccggcgccgggctcgcgttctccctgatgaagtccctgggcgggggccgccgggggaccggcgcccagggcgagaccctcggggagaagtggaagcgccagctgaaccagctgtccaagagcgagttcaacatctacaagcggagcggcatcatggaggtggaccgctccgaggccaaggaggggctcaagcggggcgagacgaccaagcacgccgtgagccgcgggaccgcgaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacaccaagggcggccccgggcacgaggagccgatccccatggccacgtacggctggaacctggtgaagctgcacagcgggaaggacgtcttcttcatgccgcccgagaagtgcgacaccctcctgtgcgacatcggcgagtccagcccgaaccccaccatcgaggaggggcgcaccctgcgggtgctcaagatggtggagccctggctgcgcggcaaccagttctgcatcaagatcctgaacccctacatgccgtccgtcgtggagacgctcgagcagatgcagcggaagtacggcgggatgctggtgcgcaaccccctgagccggaactccacccacgagatgtactgggtcagctgcggcaccgggaacatcgtgtccgccgtgaacatgaccagccgcatgctcctgaaccggttcacgatggcccaccgcaagcccacctacgagcgcgacgtcgacctgggcgcgggcacccggcacgtggccgtggagcccgaggtcgccaacctcgacatcatcgggcagcgcatcgagaacatcaagaacgagcacaagtccacctggcactacgacgaggacaacccgtacaagacgtgggcctaccacggcagctacgaggtgaagccctccgggagcgcctccagcatggtgaacggcgtcgtgcggctgctgaccaagccctgggacgtgatccccatggtcacccagatcgcgatgaccgacacgaccccgttcgggcagcagcgcgtgttcaaggagaaggtcgacacccggacgccccgggccaagcggggcacgacccagatcatggaggtgaccgccaagtggctctggggcttcctgtcccgcaacaagaagccccggatctgcacccgcgaggagttcacgcggaaggtgcgcagcaacgccgccatcggggcggtcttcgtggacgagaaccagtggaacagcgccaaggaggccgtggaggacgagcggttctgggacctggtccgccgggagcgcgagctccacaagcagggcaagtgcgcgacctgcgtgtacaacatgatggggaagcgggagaagaagctgggcgagttcgggaaggcgaagggctcccgcgccatctggtacatgtggctgggcgcccggttcctcgagttcgaggccctggggttcatgaacgaggaccactggttcagccgcgagaactccctgagcggcgtggagggggagggcctccacaagctggggtacatcctgcgggacatctccaagatcccgggcggcaacatgtacgccgacgacaccgcggggtgggacacccgcatcacggaggacgacctccagaacgaggccaagatcaccgacatcatggagcccgagcacgccctgctggccaccagcatcttcaagctcacctaccagaacaaggtcgtgcgcgtgcagcggcccgccaagaacggcacggtcatggacgtgatctcccgccgggaccagcgcgggagcggccaggtgggcacctacgggctgaacaccttcaccaacatggaggtccagctgatccggcagatggagtccgagggcatcttcctccccagcgagctggagacgccgaacctggcggagcgcgtgctcgactggctggagaagcacggggccgagcggctgaagcgcatggccatctccggcgacgactgcgtggtcaagcccatcgacgaccggttcgccaccgccctcaccgcgctgaacgacatggggaaggtgcgcaaggacatcccccagtgggagcccagcaagggctggaacgactggcagcaggtcccgttctgctcccaccacttccaccagctgatcatgaaggacggccgggagatcgtcgtgccctgccgcaaccaggacgagctcgtggggcgggcccgcgtcagccagggcgccgggtggtccctgcgggagaccgcctgcctgggcaagagctacgcccagatgtggcagctcatgtacttccaccgccgggacctgcgcctggcggccaacgccatctgctccgccgtgcccgtggactgggtccccaccagccggacgacctggagcatccacgcgcaccaccagtggatgaccaccgaggacatgctctccgtgtggaaccgcgtgtggatcgaggagaacccgtggatggaggacaagacgcacgtcagctcctgggaggaggtgccctacctggggaagcgcgaggaccagtggtgcggcagcctgatcggcctcaccgcccgggccacctgggccaccaacatccaggtggccatcaaccaggtccgccggctgatcgggaacgagaactacctggactacatgacgtccatgaagcgcttcaagaacgagagcgaccccgagggcgcgctctggtga

SEQ ID NO: 8167 - RNA, 9879 nt, synthetic construct
  misc_feature 1..9879: note = derived and/or modified CDS sequence (opt1) from DENV-1__KF973462__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccctgacctacaagtgcccccagatcatcgaggccgagcccgacgacgtggactgctggtgcaacgccaccgacacctgggtgacctacgggacctgcagccagaccggcgagcaccggcgggacaagcgctccgtggccctggcgccccacgtgggcctcgggctggagacccggaccgagacctggatgagctccgagggcgcctggaagcagatccagcgcgtcgagacctgggccctgcggcaccccgggttcaccgtgatcgccctcttcctggcgcacgccatcggcacgagcatcacccagaaggggatcatcttcatcctgctcatgctggtgaccccctccatggccatgcgctgcgtcggcatcggcaaccgggacttcgtggaggggctgagcggcgccacctgggtggacgtcgtgctcgagcacgggtcctgcgtgacgaccatggccaagaacaagcccaccctggacatcgagctgctcaagaccgaggtcacgaaccccgcgatcctgcgcaagctgtgcatcgaggccaagatcagcaacaccaccaccgactcccggtgcccgacgcagggcgaggccaccctcgtggaggagcaggacgccaacttcgtgtgccgccggaccttcgtcgaccgcggctgggggaacggctgcgggctgttcggcaaggggagcctgctgacctgcgccaagttcaagtgcgtgacgaagctggagggcaagatcgtgcagtacgagaacctgaagtactccgtcatcgtgaccgtgcacaccggcgaccagcaccaggtcgggaacgagaccacggagcacggcaccatcgcgaccatcacgccccaggcccccaccagcgagatccagctcacggactacggggccctgaccctggactgcagcccccggaccggcctcgacttcaacgagatggtgctgctgaccatgaaggagaagtcctggctcgtccacaagcagtggttcctggacctgccgctcccctggacgtccggggccagcaccagccaggagacctggaaccgccaggacctgctggtgaccttcaagacggcccacgcgaagaagcaggaggtggtcgtgctcggctcccaggagggcgccatgcacaccgccctgaccggggccaccgagatccagacgagcggcaccaccaccatcttcgccgggcacctgaagtgccggctcaagatggacaagctgacgctgaagggcacctcctacgtgatgtgcaccgggagcttcaagctggagaaggagatggcggagacccagcacggcacggtcctcgtccaggtgaagtacgagggcaccgacgccccctgcaagatccccttctccacccaggacgagaagggggtcacccagaacggccgcctgatcacggccaacccgatcgtgaccgacaaggagaagcccgtgaacatcgagaccgagccgcccttcggggagagctacatcgtcgtgggcgccggcgagaaggcgctgaagctctcctggttcaagaaggggagctccatcggcaagatgttcgaggccaccgcccgcggggcccgccggatggccatcctgggcgacacggcgtgggacttcgggagcatcggcggcgtgttcacctccgtcgggaagctggtgcaccaggtgttcggcaccgcctacggggtcctcttcagcggcgtgtcctggaccatgaagatcgggatcggcatcctgctgacgtggctcggcctgaacagccgctccaccagcctgtccatgacctgcatcgccgtggggatggtcaccctctacctgggcgtgatggtgcaggccgacagcgggtgcgtcatcaactggaagggccgcgagctgaagtgcgggtccggcatcttcgtgacgaacgaggtgcacacctggaccgagcagtacaagttccaggccgacagcccgaagcggctcagcgcggccatcggcaaggcctgggaggagggggtctgcggcatccgctccgccacccggctggagaacatcatgtggaagcagatcagcaacgagctgaaccacatcctcctggagaacgacatgaagttcaccgtggtggtcggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacaaccagcgggcctggaacatctgggaggtggaggactacggcttcgggatcttcaccacgaacatctggctcaagctgcgcgactcctacacccaggtgtgcgaccaccggctgatgagcgcggccatcaaggactccaaggccgtccacgccgacatgggctactggatcgagagcgagaagaacgagacctggaagctcgcccgcgcgtccttcatcgaggtgaagacctgcacgtggcccaagagccacaccctgtggtccaacggcgtgctggagagcgagatgatcatccccaagatctacgggggcccgatctcccagcacaactaccggcccgggtacttcacccagaccgccggcccctggcacctcgggaagctggagctggacttcgacctctgcgagggcacgaccgtcgtggtggacgagcactgcggcaaccgcgggccgagcctgcggaccaccacggtcaccggcaagatcatccacgagtggtgctgccgctcctgcaccctgccgcccctgcggttccgcggggaggacggctgctggtacgggatggagatccggcccgtgaaggagaaggaggagaacctggtgcgcagcatggtctccgccggcagcggcgaggtggacagcttctccctggggatcctctgcgccagcatcatgatcgaggaggtgatgcggtcccgctggagccggaagatgctgatgaccggcacgctggccgtcttcctcctgctgatcatggggcagctcacctggaacgacctgatccgcctgtgcatcatggtgggcgcgaacgcctccgaccgcatggggatgggcaccacctacctcgccctgatggccacgttcaagatgcggccgatgttcgccgtgggcctcctcttccgccggctgaccagccgcgaggtcctgctcctgaccatcgggctgtccctcgtggcgagcgtggagctgcccaactccctggaggagctcggcgacgggctggccatgggcatcatgatgctgaagctcctgaccgagttccagccccaccagctgtggacgaccctcctgagcctgaccttcatcaagaccacgctctccctggactacgcctggaagaccaccgccatggcgctgagcatcatctccctcttccccctgtgcctgagcaccacgtcccagaagaccacctggctcccggtcctgctgggcagcttcgggtgcaagcccctcaccatgttcctgatcaccgagaacaagatctggggccggaagtcctggcccctgaacgaggggatcatggccatcggcatcgtgagcatcctcctgtccagcctgctcaagaacgacgtccccctggccgggccgctgatcgccggcggcatgctcatcgcctgctacgtgatcagcgggtccagcgcggacctgtccctggagaaggccgccgaggtgagctgggagcaggaggccgagcactccggcacgagccacaacatcctcgtcgaggtgcaggacgacgggaccatgaagatcaaggacgaggagcgcgacgacaccctgaccatcctgctcaaggccacgctgctggcggtgtccggcgtctaccccatgagcatccccgccaccctcttcgtgtggtacttctggcagaagaagaagcagcggtccggggtgctgtgggacacccccagcccgcccgaggtcgagcgcgccgtgctggacgacggcatctaccggatcctgcagcgcggcctcctggggcggtcccaggtgggcgtcggggtgttccaggacggcgtgttccacaccatgtggcacgtcacgcgcggggccgtgctgatgtaccagggcaagcggctcgagcccagctgggcctccgtgaagaaggacctgatcagctacggcgggggctggcgcttccaggggtcctggaacaccggcgaggaggtccaggtgatcgcggtggagcccgggaagaacccgaagaacgtccagaccacccccggcacgttcaagacccccgagggcgaggtgggggccatcgccctggacttcaagcccggcaccagcgggtccccgatcgtgaaccgggagggcaagatcgtcggcctctacgggaacggcgtggtgaccacgagcgggacctacgtctccgccatcgcccaggcgaaggtgagccaggagggccccctgcccgagatcgaggacgaggtgttcaagaagcgcaacctgaccatcatggacctccacccggggagcggcaagacccggcgctacctgcccgccatcgtccgggaggccatcaagcgcaagctgcggacgctcatcctggcccccacccgcgtggtggcgtccgagatggccgaggccctgaagggcatgcccatccgctaccagaccaccgccgtcaagagcgagcacacggggcgggagatcgtggacctcatgtgccacgccaccttcaccatgcgcctgctgtccccggtgcgggtccccaactacaacatgatcatcatggacgaggcgcacttcaccgaccccgccagcatcgccgcccgcggctacatctccacgcgggtggggatgggcgaggccgcggccatcttcatgaccgccacgccgcccgggagcgtggaggccttcccccagtccaacgccgtcatccaggacgaggagcgcgacatccccgagcggagctggaactccggctacgactggatcaccgacttccccggcaagacggtgtggttcgtgcccagcatcaagtccgggaacgacatcgcgaactgcctccgcaagaacggcaagcgggtcatccagctgagccgcaagaccttcgacaccgagtaccagaagaccaagaacaacgactgggactacgtggtgacgaccgacatctccgagatgggggccaacttccgggccgaccgcgtcatcgacccccggcgctgcctgaagcccgtgatcctcaaggacggccccgagcgggtgatcctggccgggccgatgcccgtcaccgtggcgagcgccgcccagcgccggggccgcatcggccggaaccagaacaaggagggggaccagtacgtgtacatgggccagcccctgaacaacgacgaggaccacgcccactggaccgaggccaagatgctcctggacaacatcaacacgcccgaggggatcatcccggcgctgttcgagcccgagcgcgagaagtccgccgccatcgacggcgagtaccgcctccgcggggaggcccgcaagaccttcgtcgagctgatgcggcgcggcgacctgcccgtgtggctcagctacaaggtcgcctccgagggcttccagtacagcgaccggcgctggtgcttcgacggggagcggaacaaccaggtgctggaggagaacatggacgtggagatctggaccaaggagggcgagcgcaagaagctgcggccccgctggctcgacgcgcggacctactccgacccgctggccctgcgcgagttcaaggagttcgccgccgggcggcgcagcgtcagcggcgacctcatcctggagatcggcaagctgccccagcacctcaccctgcgggcccagaacgcgctggacaacctcgtgatgctgcacaactccgagcagggcgggaaggcctaccgccacgccatggaggagctgcccgacacgatcgagaccctcatgctgctggccctcatcgcggtgctgaccgggggcgtcaccctgttcttcctcagcgggaagggcctgggcaagacgtccatcgggctgctctgcgtgaccgccagctccgccctgctgtggatggccagcgtggagccccactggatcgccgcgtccatcatcctcgagttcttcctgatggtcctgctcatcccggagcccgaccggcagcgcacgccccaggacaaccagctggcctacgtggtgatcggcctcctcttcatgatcctgaccgtcgccgccaacgagatggggctgctcgagacgaccaagaaggacctgggcatcgggcacgtggccgcggagaaccaccagcacgccaccatgctggacgtggacctccggccggccagcgcctggaccctgtacgccgtcgcgacgaccgtgatcacccccatgatgcgccacaccatcgagaacacgaccgccaacatctccctgaccgccatcgccaaccaggccgcgatcctcatgggcctggacaagggctggcccatcagcaagatggacatcggggtgcccctgctcgccctgggctgctactcccaggtcaacccgctgaccctcacggccgccgtgctgatgctggtggcgcactacgccatcatcgggcccggcctccaggccaaggccacccgggaggcccagaagcgcaccgcggccgggatcatgaagaaccccaccgtcgacggcatcgtggccatcgacctggaccccgtggtctacgacacgaagttcgagaagcagctgggccagatcatgctcctgatcctgtgcaccagccagatcctcctgatgcgcaccacctgggccctgtgcgagtccatcacgctcgccaccgggccgctgaccaccctgtgggagggcagccccgggaagttctggaacacgaccatcgcggtgtccatggccaacatcttccggggcagctacctcgccggcgccgggctggccttctccctgatgaagtccctcggcgggggccgccgggggaccggcgcgcagggcgagaccctgggggagaagtggaagcgccagctgaaccagctctccaagagcgagttcaacatctacaagcggagcggcatcatggaggtggaccgctccgaggccaaggaggggctgaagcggggcgagacgaccaagcacgccgtcagccgcgggaccgccaagctgcggtggttcgtggagcgcaacctggtgaagcccgagggcaaggtcatcgacctcggctgcgggcggggcgggtggtcctactactgcgcgggcctgaagaaggtgaccgaggtgaaggggtacaccaagggcggccccgggcacgaggagccgatccccatggccacgtacggctggaacctggtccgcctccacagcgggaaggacgtgttcttcatgccgcccgagaagtgcgacaccctgctgtgcgacatcggcgagtccagcccgaaccccaccatcgaggaggggcggaccctccgcgtgctgaagatggtcgagccctggctgcggggcaaccagttctgcatcaagatcctcaacccctacatgccgtccgtggtggagacgctggagcagatgcagcgcaagtacggcgggatgctggtccggaaccccctcagccgcaactccacccacgagatgtactgggtgagctgcggcaccgggaacatcgtgtccgccgtcaacatgaccagccggatgctgctgaaccgcttcacgatggcccaccgcaagcccacctacgagcgggacgtggacctcggcgccggcacccgccacgtggcggtcgagcccgaggtggccaacctggacatcatcgggcagcggatcgagaacatcaagaacgagcacaagtccacctggcactacgacgaggacaacccgtacaagacgtgggcctaccacggcagctacgaggtgaagccctccgggagcgcctccagcatggtcaacggcgtggtgcgcctgctcaccaagccctgggacgtcatccccatggtgacccagatcgccatgaccgacacgaccccgttcgggcagcagcgggtcttcaaggagaaggtggacacccgcacgccccgggcgaagcgcggcacgacccagatcatggaggtgaccgccaagtggctgtggggcttcctgtcccggaacaagaagccccgcatctgcacccgggaggagttcacgcgcaaggtccggagcaacgccgccatcggggccgtgttcgtggacgagaaccagtggaacagcgcgaaggaggccgtcgaggacgagcgcttctgggacctcgtgcaccgggagcgcgagctgcacaagcagggcaagtgcgcgacctgcgtgtacaacatgatggggaagcgggagaagaagctgggcgagttcgggaaggccaagggctcccgcgcgatctggtacatgtggctcggcgcccggttcctggagttcgaggccctggggttcatgaacgaggaccactggttcagccgcgagaactccctcagcggcgtcgagggggagggcctgcacaagctggggtacatcctccgggacatctccaagatcccgggcggcaacatgtacgccgacgacaccgccgggtgggacacccgcatcacggaggacgacctgcagaacgaggcgaagatcaccgacatcatggagcccgagcacgccctgctcgccaccagcatcttcaagctgacctaccagaacaaggtggtgcgcgtccagcggcccgccaagaacggcacggtgatggacgtgatctcccgccgggaccagcgcgggagcggccaggtcggcacctacgggctgaacaccttcaccaacatggaggtgcagctcatccggcagatggagtccgagggcatcttcctgcccagcgagctggagacgccgaacctcgccaagcgcgtgctggactggctggagaagcacggggcggagcggctcaagcgcatggccatctccggcgacgactgcgtcgtgaagcccatcgacgaccggttcgccaccgccctgaccgccctgaacgacatggggaagatccgcaaggacatcccccagtgggagcccagcaagggctggaacgactggcagcaggtcccgttctgctcccaccacttccaccagctcatcatgaaggacggccgggagatcgtcgtgccctgccgcaaccaggacgagctggtggggcgggcgcgcgtcagccagggcgccgggtggtccctgcgggagaccgcctgcctcggcaagagctacgcccagatgtggcagctgatgtacttccaccgccgggacctgcgcctcgccgcgaacgccatctgctccgccgtgcccgtggactgggtccccaccagccggacgacctggagcatccacgcccaccaccagtggatgaccaccgaggacatgctgtccgtgtggaaccgcgtgtggatcgaggagaacccgtggatggaggacaagacgcacgtcagctcctgggaggaggtgccctacctggggaagcgcgaggaccagtggtgcggcagcctcatcggcctgaccgcgcgggccacctgggccaccaacatccaggtggccatcaaccaggtccgccggctgatcgggaacgagaactacctcgactacatgacgtccatgaagcgcttcaagaacgagagcgaccccgagggcgccctgtggtga

SEQ ID NO: 8168 - RNA, 9879 nt, synthetic construct
  misc_feature 1..9879: note = derived and/or modified CDS sequence (opt1) from DENV-1__KF973463__SS-prME
  source 1..9879: mol_type = other RNA
agcgtgaccatgctgctcatgctgatgcccaccgccctggccttccacctcacgacccgcggcggggagccgcacatgatcgtctccaagcacgagcggggcaaggcgctgctgttcaagaccagcaccggggtgaacatgtgcacgctcatcgccatggacctgggcgagctgtgcgaggacaccatgacctacaagtgcccccgcatcaccgaggccgagcccgacgacgtggactgctggtgcaacgccacggacacctgggtcacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccacccggggttcaccgtgatcgccctgttcctggcgcacgccatcggcacctccatcacccagaaggggatcatcttcatcctcctgatgctggtgacgcccagcatggccatgcggtgcgtcggcatcggcaaccgcgacttcgtggaggggctctccggcgccacctgggtggacgtcgtgctggagcacgggagctgcgtgaccaccatggccaagaacaagcccacgctggacatcgagctcctgaagaccgaggtcaccaaccccgcggtgctgcggaagctctgcatcgaggccaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcctgacctgcgccaagttcaagtgcgtgaccaagctggagggcaagatcgtccagtacgagaacctcaagtacagcgtgatcgtgaccgtccacacgggcgaccagcaccaggtggggaacgagaccaccgagcacggcaccatcgcgaccatcacgccccaggcccccacctccgagatccagctgaccgactacggggccctgaccctcgactgcagcccccgcacgggcctggacttcaacgagatggtcctgctcaccatgaaggagaagtcctggctggtgcacaagcagtggttcctggacctcccgctgccctggaccagcggggcctccaccagccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcaccagctacgtcatgtgcacggggtccttcaagctggagaaggaggtggcggagacccagcacggcaccgtgctggtccaggtgaagtacgagggcaccgacgccccctgcaagatccccttcagcacgcaggacgagaagggggtgacccagaacggccggctgatcaccgccaacccgatcgtcaccgacaaggagaagcccgtgaacatcgagacggagccccccttcggggagtcctacatcgtggtcggcgccggcgagaaggcgctcaagctgagctggttcaagaaggggtccagcatcggcaagatgttcgaggccaccgcccgcggggcccggcgcatggccatcctgggcgacaccgcgtgggacttcgggtccatcggcggcgtgttcaccagcgtggggaagctcgtccaccaggtgttcggcacggcctacggggtgctgttctccggcgtcagctggaccatgaagatcgggatcggcatcctgctcacctggctgggcctgaactcccgcagcacctccctcagcatgacgtgcatcgccgtggggatggtgaccctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgactccccgaagcgcctgagcgcggccatcggcaaggcctgggaggagggggtgtgcggcatccggagcgccacgcgcctggagaacatcatgtggaagcagatctccaacgagctcaaccacatcctgctggagaacgacatgaagttcaccgtcgtggtgggggacgccaacggcatcctcgcgcaggggaagaagatgatccggccccagcccatggagcacaagtacagctggaagtcctggggcaaggccaagatcatcggcgccgacatccagaacaccaccttcatcatcgacgggcccgacacgccggagtgccccgacgaccagcgcgcctggaacatctgggaggtcgaggactacggcttcgggatcttcaccaccaacatctggctgaagctgcgggacagctacacccagatgtgcgaccaccgcctcatgtccgcggccatcaaggacagcaaggccgtgcacgccgacatgggctactggatcgagtccgagaagaacgagacgtggaagctggcccgggcgagcttcatcgaggtgaagacctgcacctggcccaagtcccacaccctgtggagcaacggcgtcctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctcccccccctgcgcttccggggggaggacggctgctggtacgggatggagatccgccccgtgaaggagaaggaggagaacctggtccggtccatggtgagcgccggctccggcgaggtggacagcttcagcctcgggatcctgtgcgtctccatcatgatcgaggaggtgatgcgcagccggtggtcccgcaagatgctgatgaccggcaccctcgccgtgttcctgctgctcatcatggggcagctgacctggaacgacctgatccgcctctgcatcatggtcggcgccaacgcgagcgacaagatggggatgggcacgacctacctggccctgatggccaccttcaagatgcggccgatgttcgccgtgggcatcctcttccgccggctgacctcccgcgaggtgctgctcctgacgatcgggctgagcctcgtcgcctccgtggagctgcccaacagcctggaggagctcggcgacgggctggcgatgggcatcatgatgctgaagctcctgaccgagttccagccccaccagctgtggaccaccctcctgtccctgacgttcatcaagaccaccctcagcctggactacgcctggaagaccacggccatggccctgtccatcgtcagcctcttccccctgtgcctgtccaccaccagccagaagaccacctggctcccggtgctgctgggctccttcgggtgcaagcccctcacgatgttcctgatcaccgagaacaagatctggggccggaagagctggcccatcaacgaggggatcatggcgatcggcatcgtgtccatcctgctcagctccctgctgaagaacgacgtccccctcgccgggccgctgatcgccggcggcatgctgatcgcctgctacgtgatcagcgggagctccgccgacctcagcctggagaaggcggccgaggtgtcctgggagcaggaggccgagcacagcggcacctcccacaacatcctggtcgaggtgcaggacgacgggaccatgcgcatcaaggacgaggagaaggacgacacgctcaccatcctgctgaaggccaccctcctggccgtgagcggcgtctaccccatgtccatccccgcgaccctgttcgtgtggtacttctggcagaagaagaagcagcggagcggggtgctctgggacacgccctccccgcccgaggtcgagcgcgccgtgctggacgacggcatctaccggatcctgcagcgcggcctcctggggcggagccaggtgggcgtcggggtgttccaggacggcgtgttccacaccatgtggcacgtcacccgcggggccgtgctgatgtaccagggcaagcggctggagccctcctgggccagcgtgaagaaggacctcatctcctacggcgggggctggcgcttccaggggagctggaacaccggcgaggaggtccaggtgatcgccgtggagcccgggaagaacccgaagaacgtccagacgacccccggcaccttcaagacctccgagggcgaggtgggggcgatcgccctggacttcaagcccggcacgagcgggtcccccatcgtgaaccgggagggcaagatcgtcggcctgtacgggaacggcgtggtgaccaccagcgggacctacgtctccgccatcgcccaggccaagacgagccaggagggcccgctccccgagatcgaggacgaggtgttcaagaagcgcaacctgaccatcatggacctgcaccccgggagcggcaagacccggcgctacctcccggcgatcgtgcgggaggccatcaagaagaagctgcgcaccctgatcctcgcccccacgcgggtcgtggcctccgagatggcggaggccctgaagggcatgcccatccgctaccagaccaccgccgtgaagagcgagcacaccgggcgcgagatcgtcgacctgatgtgccacgccacgttcaccatgcggctcctgtcccccgtgcgcgtgccgaactacaacatgatcatcatggacgaggcccacttcaccgaccccgcgagcatcgccgcccggggctacatctccacccgcgtcgggatgggcgaggccgccgcgatcttcatgacggccaccccccccgggagcgtggaggccttcccgcagtccaacgccgtgatccaggacgaggagcgggacatccccgagcgcagctggaactccggctacgactggatcaccgacttccccggcaagaccgtctggttcgtgcccagcatcaagtccgggaacgacatcgccaactgcctgcggaagaacggcaagcgcgtgatccagctcagccggaagacgttcgacaccgagtaccagaagaccaagaacaacgactgggactacgtcgtgaccacggacatctccgagatgggggcgaacttccgcgccgaccgggtgatcgacccgcgccggtgcctgaagcccgtcatcctgaaggacggccccgagcgcgtgatcctcgccgggcccatgccggtgaccgtcgccagcgcggcccagcggcgcggccggatcggccgcaaccagaacaaggagggggaccagtacgtgtacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccggaagaccttcgtcgagctcatgcgccggggcgacctgcccgtgtggctgagctacaaggtggcctccgagggcttccagtacagcgaccgccggtggtgcttcgacggggagcgcaacaaccaggtcctcgaggagaacatggacgtggagatctggacgaaggagggcgagcggaagaagctgcgcccccggtggctggacgcccgcacctactccgaccccctcgcgctgcgggagttcaaggagttcgccgccgggcgccggagcgtgagcggcgacctgatcctcgagatcggcaagctgccgcagcacctgaccctccgcgcccagaacgccctggacaacctggtcatgctccacaactccgagcaggggggcaaggcgtaccggcacgccatggaggagctgcccgacaccatcgagacgctgatgctcctggccctgatcgccgtgctcaccgggggcgtgaccctgttcttcctgagcgggaagggcctcggcaagacctccatcgggctgctgtgcgtcacggcgagctccgccctcctgtggatggccagcgtggagccccactggatcgccgcctccatcatcctggagttcttcctcatggtgctgctgatccccgagccggaccgccagcggaccccccaggacaaccagctcgcgtacgtcgtgatcggcctgctgttcatgatcctcaccgtggccgccaacgagatggggctgctggagaccacgaagcgcgacctcggcatcgggcacgtcgccgccgagaaccaccagcacgcgaccatgctggacgtggacctgcggcccgccagcgcctggaccctctacgccgtggccaccacggtcatcaccccgatgatgcgccacaccatcgagaacaccacggcgaacatctccctgaccgccatcgccaaccaggccgccatcctgatgggcctcgacaagggctggcccatcagcaagatggacatcggggtgcccctgctggcgctcggctgctactcccaggtgaaccccctgaccctgaccgccgccgtcctcatgctggtggcccactacgcgatcatcgggccgggcctgcaggccaaggccacgcgggaggcccagaagcgcaccgccgcggggatcatgaagaaccccaccgtggacggcatcgtcgccatcgacctcgaccccgtggtgtacgacgccaagttcgagaagcagctgggccagatcatgctgctcatcctgtgcaccagccagatcctgctcatgcgcacgacctgggccctgtgcgagtccatcaccctggccaccgggcccctcacgaccctgtgggagggcagcccggggaagttctggaacaccaccatcgcggtctccatggccaacatcttccggggcagctacctggccggcgccgggctcgccttctccctgatgaagagcctgggcgggggccgccgggggacgggcgcgcagggcgagaccctcggggagaagtggaagcgccagctgaaccagctgtccaagcccgagttcaacacctacaagcggagcggcatcatggaggtggaccgcagcgaggccaaggaggggctcaagcggggcgagaccaccaagcacgccgtgtcccgcgggacggccaagctgcggtggttcgtcgagcgcaacctggtgaagcccgagggcaaggtgatcgacctcggctgcgggcggggcgggtggagctactactgcgcgggcctgaagaaggtcaccgaggtgaaggggtacaccaagggcggccccgggcacgaggagccgatccccatggccacctacggctggaacctggtgaagctgcactccgggaaggacgtcttcttcatgccccccgagaagtgcgacacgctcctgtgcgacatcggcgagagctccccgaaccccaccatcgaggaggggcgcaccctgcgggtgctcaagatggtggagccctggctgcgcggcaaccagttctgcatcaagatcctgaacccctacatgccgagcgtcgtggagaccctcgagcagatgcagcggaagcacggcgggatgctggtgcgcaaccccctgtcccggaacagcacgcacgagatgtactgggtctcctgcggcaccgggaacatcgtgagcgccgtgaacatgacctcccgcatgctcctgaaccggttcaccatggcccaccgcaagcccacgtacgagcgcgacgtcgacctgggcgccggcacccggcacgtggcggtggagcccgaggtcgccaacctcgacatcatcgggcagcgcatcgagaacatcaagaacgagcacaagagcacctggcactacgacgaggacaacccgtacaagacctgggcctaccacggctcctacgaggtgaagcccagcgggtccgccagctccatggtgaacggcgtcgtgcggctgctgacgaagccctgggacgtcatccccatggtgacccagatcgccatgaccgacaccacgccgttcgggcagcagcgcgtgttcaaggagaaggtcgacacccggaccccccgcgcgaagcggggcaccacgcagatcatggaggtgaccgccaagtggctctggggcttcctgagccgcaacaagaagccccggatctgcacccgcgaggagttcacccggaaggtgcgctccaacgccgccatcggggccgtcttcgtggacgagaaccagtggaacagcgcgaaggaggccgtggaggacgagcggttctgggacctggtccaccgcgagcgggagctccacaagcagggcaagtgcgccacgtgcgtgtacaacatgatggggaagcgcgagaagaagctgggcgagttcgggaaggccaagggcagccgggcgatctggtacatgtggctgggcgcccgcttcctcgagttcgaggccctggggttcatgaacgaggaccactggttctcccgggagaacagcctgtccggcgtggagggggagggcctccacaagctggggtacatcctgcgcgacatcagcaagatcccgggcggcaacatgtacgccgacgacaccgccgggtgggacacccggatcaccgaggacgacctccagaacgaggcgaagatcacggacatcatggagcccgagcacgccctgctggccacctccatcttcaagctcacctaccagaacaaggtcgtgcgcgtgcagcgccccgccaagaacggcaccgtcatggacgtgatcagccggcgcgaccagcgggggtccggccaggtgggcacgtacgggctgaacaccttcaccaacatggaggtccagctgatccgccagatggagagcgagggcatcttcctcccctccgagctggagaccccgaacctggccgagcgggtgctcgactggctggagaagcacggggcggagcgcctgaagcggatggccatcagcggcgacgactgcgtggtcaagcccatcgacgaccgcttcgccaccgccctcacggccctgaacgacatggggaaggtgcggaaggacatcccccagtgggagccctccaagggctggaacgactggcagcaggtgccgttctgcagccaccacttccaccagctgatcatgaaggacggccgcgagatcgtcgtgccctgccggaaccaggacgagctcgtggggcgcgcgcgggtctcccagggcgccgggtggagcctgcgcgagaccgcctgcctgggcaagtcctacgcccagatgtggcagctcatgtacttccaccggcgcgacctgcggctggccgcgaacgccatctgcagcgccgtgcccgtggactgggtccccacctcccgcaccacgtggagcatccacgcccaccaccagtggatgaccaccgaggacatgctcagcgtgtggaaccgggtgtggatcgaggagaacccgtggatggaggacaagacccacgtctccagctgggaggaggtgccctacctggggaagcgcgaggaccagtggtgcggctccctgatcggcctcacggcgcgcgccacctgggccaccaacatccaggtggccatcaaccaggtccggcgcctgatcgggaacgagaactacctggactacatgaccagcatgaagcggttcaagaacgagtccgaccccgagggcgccctctggtga

SEQ ID NO: 8169 - RNA, 9879 nt, synthetic construct
  misc_feature 1..9879: note = derived and/or modified CDS sequence (opt1) from DENV-1__KF973464__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccgccgggacaagcgctccgtggccctggcgccccacgtgggcctggggctcgagacccggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcatctccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggccatcggcatcgtgagcatcctgctctccagcctgctgaagaacgacgtccccctcgccgggccgctgatcgccggcggcatgctgatcgcctgctacgtgatcagcgggtccagcgcggacctctccctggagaaggccgccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggcggtgtccggcgtctaccccatgagcatccccgccaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgcggtggagcccgggaagaacccgaagaacgtccagaccacgcccggcatcttcaagacccccgagggcgaggtgggggccatcgccctggacttcaagcccggcaccagcgggtccccgatcgtgaaccgggagggcaagatcgtcggcctgtacgggaacggcgtggtgaccacgagcgggacctacgtctccgccatcgcccaggcgaaggccagccaggagggccccctccccgagatcgaggacgaggtgttcaagaagcgcaacctgaccatcatggacctgcacccggggagcggcaagacccggcgctacctccccgccatggtgcgggaggccatcaagcgcaagctgcggacgctgatcctcgcgcccacccgcgtcgtggcctccgagatggccgaggccctgaagggcatgcccatccgctaccagaccaccgccgtcaagagcgagcacacggggcgggagatcgtcgacctgatgtgccacgcgaccttcaccatgcgcctcctgtccccggtgcgggtgcccaactacaacatgatcatcatggacgaggcccacttcaccgaccccgccagcatcgccgcccgcggctacatctccacgcgggtcgggatgggcgaggcggccgccatcttcatgaccgccacgccgcccgggagcgtggaggccttcccccagtccaacgcggtgatccaggacgaggagcgcgacatccccgagcggagctggaactccggctacgactggatcaccgacttccccggcaagacggtctggttcgtgcccagcatcaagtccgggaacgacatcgccaactgcctgcgcaagaacggcaagcgggtgatccagctcagccgcaagaccttcgacaccgagtaccagaagaccaagaacaacgactgggactacgtcgtgacgaccgacatctccgagatgggggccaacttccgggccgaccgcgtgatcgacccccggcgctgcctgaagcccgtcatcctgaaggacggccccgagcgggtgatcctcgcggggccgatgcccgtgaccgtcgccagcgccgcccagcgccggggccgcatcggccggaaccagaacaaggagggggaccagtacgtgtacatgggccagcccctgaacaacgacgaggaccacgcccactggaccgaggcgaagatgctgctcgacaacatcaacacgcccgaggggatcatcccggccctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcgtccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgaccctccgggcgcagaacgccctggacaacctggtcatgctccacaactccgagcagggcgggaaggcctaccgccacgccatggaggagctgcccgacacgatcgagaccctgatgctcctggcgctgatcgccgtgctcaccgggggcgtgaccctgttcttcctgagcgggaagggcctcggcaagacgtccatcgggctgctgtgcgtcaccgccagctccgccctcctgtggatggccagcgtggagccccactggatcgcggcctccatcatcctggagttcttcctcatggtgctgctgatcccggagcccgaccggcagcgcacgccccaggacaaccagctcgcctacgtcgtgatcggcctgctgttcatgatcctcaccgtggccgccaacgagatggggctgctggagacgaccaagaaggacctcggcatcgggcacgtcgcggccgagaaccaccagcacgccaccatgctggacgtggacctgcggccggccagcgcctggaccctctacgcggtggccacgaccgtcatcacccccatgatgcgccacaccatcgagaacacgaccgccaacatctccctgaccgccatcgccaaccaggcggccatcctgatgggcctcgacaagggctggcccatcagcaagatggacatcggggtgcccctgctggccctcggctgctactcccaggtgaacccgctgaccctgacggccgcggtcctcatgctggtggcccactacgccatcatcgggcccggcctgcaggccaaggccacccgggaggcgcagaagcgcaccgccgccgggatcatgaagaaccccaccgtggacggcatcgtcgccatcgacctcgaccccgtggtgtacgacacgaagttcgagaagcagctgggccagatcatgctgctcatcctgtgcaccagccagatcctgctcatgcgcaccacctgggccctgtgcgagtccatcacgctggcgaccgggccgctcaccaccctgtgggagggcagccccgggaagttctggaacacgaccatcgccgtctccatggccaacatcttccggggcagctacctggccggcgccgggctcgcgttctccctgatgaagtccctgggcgggggccgccgggggaccggcgcccagggcgagaccctcggggagaagtggaagcgccagctgaaccagctgtccaagagcgagttcaacatctacaagcggagcggcatcatggaggtggaccgctccgaggccaaggaggggctcaagcggggcgagacgaccaagcacgccgtgagccgcgggaccgcgaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacaccaagggcggccccgggcacgaggagccgatccccatggccacgtacggctggaacctggtgaagctgcacagcgggaaggacgtcttcttcatgccgcccgagaagtgcgacaccctcctgtgcgacatcggcgagtccagcccgaaccccaccatcgaggaggggcgcaccctgcgggtgctcaagatggtggagccctggctgcgcggcaaccagttctgcatcaagatcctgaacccctacatgccgtccgtcgtggagacgctcgagcagatgcagcggaagtacggcgggatgctggtgcgcaaccccctgagccggaactccacccacgagatgtactgggtcagctgcggcaccgggaacatcgtgtccgccgtgaacatgaccagccgcatgctcctgaaccggttcacgatggcccaccgcaagcccacctacgagcgcgacgtcgacctgggcgcgggcacccggcacgtggccgtggagcccgaggtcgccaacctcgacatcatcgggcagcgcatcgagaacatcaagaacgagcacaagtccacctggcactacgacgaggacaacccgtacaagacgtgggcctaccacggcagctacgaggtgaagccctccgggagcgcctccagcatggtgaacggcgtcgtgcggctgctgaccaagccctgggacgtgatccccatggtcacccagatcgcgatgaccgacacgaccccgttcgggcagcagcgcgtgttcaaggagaaggtcgacacccggacgccccgggccaagcggggcacgacccagatcatggaggtgaccgccaagtggctctggggcttcctgtcccgcaacaagaagccccggatctgcacccgcgaggagttcacgcggaaggtgcgcagcaacgccgccatcggggcggtcttcgtggacgagaaccagtggaacagcgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggcgaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatcccgggcggcaacatgtacgccgacgacaccgcggggtgggacacccggatcacggaggacgacctccagaacgaggccaagatcaccgacatcatggagcccgagcacgccctgctggccaccagcatcttcaagctcacctaccagaacaaggtcgtgcgcgtgcagcgccccgccaagaacggcacggtcatggacgtgatctcccggcgcgaccagcgggggagcggccaggtgggcacctacgggctgaacaccttcaccaacatggaggtccagctgatccgccagatggagtccgagggcatcttcctccccagcgagctggagacgccgaacctggcggagcgggtgctcgactggctggagaagcacggggccgagcgcctgaagcggatggccatctccggcgacgactgcgtggtcaagcccatcgacgaccgcttcgccaccgccctcaccgcgctgaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctcgtggggcgcgcccgggtcagccagggcgccgggtggtccctgcgcgagaccgcctgcctgggcaagagctacgcccagatgtggcagctcatgtacttccaccggcgcgacctgcggctggcggccaacgccatctgctccgccgtgcccgtggactgggtccccaccagccgcacgacctggagcatccacgcgcaccaccagtggatgaccaccgaggacatgctctccgtgtggaaccgggtgtggatcgaggagaacccgtggatggaggacaagacgcacgtcagctcctgggaggaggtgccctacctggggaagcgcgaggaccagtggtgcggcagcctgatcggcctcaccgcccgcgccacctgggccaccaacatccaggtggccatcaaccaggtccggcgcctgatcgggaacgagaactacctggactacatgacgtccatgaagcggttcaagaacgagagcgaccccgagggcgcgctctggtga

SEQ ID NO: 8170 - RNA, 9879 nt, synthetic construct
  misc_feature 1..9879: note = derived and/or modified CDS sequence (opt1) from DENV-1__KF973465__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccagatcaccgaggccgagcccgacgacgtggactgctggtgcaacgccaccgacacctgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatgggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgagctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccctggccgtcttcctgctcctgatcatggggcagctgacctggaacgacctcatccgcctgtgcatcatggtgggcgcgaacgcctccgaccgcatggggatgggcaccacgtacctggccctcatggccaccttcaagatgcggccgatgttcgccgtggggctgctgttccgccggctcaccagccgcgaggtcctgctgctcaccatcgggctgtccctggtggcgagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggaagaccaccgccatggcgctgagcatcatctccctgttccccctctgcctgagcacgacctcccagaagaccacctggctgccggtcctcctgggcagcttcgggtgcaagcccctgaccatgttcctcatcacggagaacaagatctggggccggaagtcctggcccctgaacgaggggatcatggccatcggcatcgtgagcatcctgctctccagcctgctgaagaacgacgtccccctcgccgggccgctgatcgccggcggcatgctgatcgcctgctacgtgatcagcgggtccagcgcggacctctccctggagaaggccgccgaggtgagctgggagcaggaggccgagcactccggcaccagccacaacatcctggtcgaggtgcaggacgacgggaccatgaagatcaaggacgaggagcgcgacgacaccctcacgatcctgctgaaggccaccctcctggcggtgtccggcgtctaccccatgagcatccccgccaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgcggtggagcccgggaagaacccgaagaacgtccagaccacgcccggcaccttcaagacccccgagggcgaggtgggggccatcgccctggacttcaagcccggcaccagcgggtccccgatcgtgaaccgggagggcaagatcgtcggcctgtacgggaacggcgtggtgacgaccagcgggacctacgtctccgccatcgcccaggcgaaggccagccaggagggccccctccccgagatcgaggacgaggtgttcaagaagcgcaacctgaccatcatggacctgcacccggggagcggcaagacgcggcgctacctccccgccatcgtgcgggaggccatcaagcgcaagctgcggaccctgatcctcgcgcccacccgcgtcgtggcctccgagatggccgaggccctgaagggcatgcccatccgctaccagaccacggccgtcaagagcgagcacaccgggcgggagatcgtcgacctgatgtgccacgcgaccttcaccatgcgcctcctgtccccggtgcgggtgcccaactacaacatgatcatcatggacgaggcccacttcacggaccccgccagcatcgccgcccgcggctacatctccacccgggtcgggatgggcgaggcggccgccatcttcatgaccgccacgccgcccgggagcgtggaggccttcccccagtccaacgcggtgatccaggacgaggagcgcgacatccccgagcggagctggaactccggctacgactggatcacggacttccccggcaagaccgtctggttcgtgcccagcatcaagtccgggaacgacatcgccaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgcggggccgatgcccgtgaccgtcgccagcgccgcccagcgccggggccgcatcggccggaaccagaacaaggagggggaccagtacgtgtacatgggccagcccctgaacaacgacgaggaccacgcccactggacggaggcgaagatgctgctcgacaacatcaacacccccgaggggatcatcccggccctgttcgagcccgagcgcgagaagtccgccgccatcgacggcgagtaccgcctgcgcggggaggcccgcaagaccttcgtggagctcatgcggcgcggcgacctgcccgtctggctgagctacaaggtggcgtccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcccggacctactccgacccgctcgccctgcgcgagttcaaggagttcgccgccgggcggcgcagcgtgagcggcgacctgatcctcgagatcggcaagctgccccagcacctgacgctccgggcgcagaacgccctggacaacctggtcatgctccacaactccgagcagggcgggaaggcctaccgccacgccatggaggagctgcccgacaccatcgagaccctgatgctcctggcgctgatcgccgtgctcaccgggggcgtgacgctgttcttcctgagcgggaagggcctcggcaagacctccatcgggctgctgtgcgtcaccgccagctccgccctcctgtggatggccagcgtggagccccactggatcgcggcctccatcatcctggagttcttcctcatggtgctgctgatcccggagcccgaccggcagcgcacgccccaggacaaccagctcgcctacgtcgtgatcggcctgctgttcatgatcctcacggtggccgccaacgagatggggctgctggagaccaccaagaaggacctcggcatcgggcacgtcgcggccgagaaccaccagcacgccaccatgctggacgtggacctgcggccggccagcgcctggacgctctacgcggtggccaccaccgtcatcacccccatgatgcgccacacgatcgagaacaccaccgccaacatctccctgaccgccatcgccaaccaggcggccatcctgatgggcctcgacaagggctggcccatcagcaagatggacatcggggtgcccctgctggccctcggctgctactcccaggtgaacccgctgacgctgaccgccgcggtcctcatgctggtggcccactacgccatcatcgggcccggcctgcaggccaaggccacccgggaggcgcagaagcgcaccgccgccgggatcatgaagaaccccacggtggacggcatcgtcgccatcgacctcgaccccgtggtgtacgacaccaagttcgagaagcagctgggccagatcatgctgctcatcctgtgcaccagccagatcctgctcatgcgcaccacgtgggccctgtgcgagtccatcaccctggcgaccgggccgctcaccacgctgtgggagggcagccccgggaagttctggaacaccaccatcgccgtctccatggccaacatcttccggggcagctacctggccggcgccgggctcgcgttctccctgatgaagtccctgggcgggggccgccgggggaccggcgcccagggcgagacgctcggggagaagtggaagcgccagctgaaccagctgtccaagagcgagttcaacatctacaagcggagcggcatcatggaggtggaccgctccgaggccaaggaggggctcaagcggggcgagaccaccaagcacgccgtgagccgcgggaccgcgaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacacgaagggcggccccgggcacgaggagccgatccccatggccacctacggctggaacctggtgaagctgcacagcgggaaggacgtcttcttcatgccgcccgagaagtgcgacaccctcctgtgcgacatcggcgagtccagcccgaaccccaccatcgaggaggggcgcacgctgcgggtgctcaagatggtggagccctggctgcgcggcaaccagttctgcatcaagatcctgaacccctacatgccgtccgtcgtggagaccctcgagcagatgcagcggaagtacggcgggatgctggtgcgcaaccccctgagccggaactccacccacgagatgtactgggtcagctgcggcaccgggaacatcgtgtccgccgtgaacatgacgagccgcatgctcctgaaccggttcaccatggcccaccgcaagcccacctacgagcgcgacgtcgacctgggcgcgggcacccggcacgtggccgtggagcccgaggtcgccaacctcgacatcatcgggcagcgcatcgagaacatcaagaacgagcacaagtccacgtggcactacgacgaggacaacccgtacaagacctgggcctaccacggcagctacgaggtgaagccctccgggagcgcctccagcatggtgaacggcgtcgtgcggctgctgaccaagccctgggacgtgatccccatggtcacccagatcgcgatgacggacaccaccccgttcgggcagcagcgcgtgttcaaggagaaggtcgacacccggacgccccgcgccaagcggggcaccacccagatcatggaggtgaccgccaagtggctctggggcttcctgtcccgcaacaagaagccccggatctgcacgcgcgaggagttcacccggaaggtgcgcagcaacgccgccatcggggcggtcttcgtggacgagaaccagtggaacagcgccaaggaggccgtggaggacgagcggttctgggacctggtccgccgggagcgcgagctccacaagcagggcaagtgcgcgacctgcgtgtacaacatgatggggaagcgggagaagaagctgggcgagttcgggaaggcgaagggctcccgcgccatctggtacatgtggctgggcgcccggttcctcgagttcgaggccctggggttcatgaacgaggaccactggttcagccgcgagaactccctgagcggcgtggagggggagggcctccacaagctggggtacatcctgcgggacatctccaagatcccgggcggcaacatgtacgccgacgacaccgcggggtgggacacgcgcatcaccgaggacgacctccagaacgaggccaagatcaccgacatcatggagcccgagcacgccctgctggccaccagcatcttcaagctcacgtaccagaacaaggtcgtgcgcgtgcagcggcccgccaagaacggcaccgtcatggacgtgatctcccgccgggaccagcgcgggagcggccaggtgggcacctacgggctgaacaccttcacgaacatggaggtccagctgatccggcagatggagtccgagggcatcttcctccccagcgagctggagaccccgaacctggcggagcgcgtgctcgactggctggagaagcacggggccgagcggctgaagcgcatggccatctccggcgacgactgcgtggtcaagcccatcgacgaccggttcgccaccgccctcaccgcgctgaacgacatggggaaggtgcgcaaggacatcccccagtgggagcccagcaagggctggaacgactggcagcaggtcccgttctgctcccaccacttccaccagctgatcatgaaggacggccgggagatcgtcgtgccctgccgcaaccaggacgagctcgtggggcgggcccgcgtcagccagggcgccgggtggtccctgcgggagaccgcctgcctgggcaagagctacgcccagatgtggcagctcatgtacttccaccgccgggacctgcgcctggcggccaacgccatctgctccgccgtgcccgtggactgggtccccacgagccggaccacctggagcatccacgcgcaccaccagtggatgaccacggaggacatgctctccgtgtggaaccgcgtgtggatcgaggagaacccgtggatggaggacaagacccacgtcagctcctgggaggaggtgccctacctggggaagcgcgaggaccagtggtgcggcagcctgatcggcctcaccgcccgggccacctgggccacgaacatccaggtggccatcaaccaggtccgccggctgatcgggaacgagaactacctggactacatgacctccatgaagcgcttcaagaacgagagcgaccccgagggcgcgctctggtga

SEQ ID NO: 8171 - RNA, 9879 nt, synthetic construct
  misc_feature 1..9879: note = derived and/or modified CDS sequence (opt1) from DENV-1__KF973466__SS-prME
  source 1..9879: mol_type = other RNA
agcgtgaccatgctgctcatgctgatgcccaccgccctggccttccacctcacgacccgcggcggggagccgcacatgatcgtctccaagcacgagcggggcaaggcgctgctgttcaagaccagcaccggggtgaacatgtgcacgctcatcgccatggacctgggcgagctgtgcgaggacaccatgacctacaagtgcccccgcatcaccgaggccgagcccgacgacgtggactgctggtgcaacgccacggacacctgggtcacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccacccggggttcaccgtgatcgccctgttcctggcgcacgccatcggcacctccatcacccagaaggggatcatcttcatcctcctgatgctggtgacgcccagcatggccatgcggtgcgtcggcatcggcaaccgcgacttcgtggaggggctctccggcgccacctgggtggacgtcgtgctggagcacgggagctgcgtgaccaccatggccaagaacaagcccacgctggacatcgagctcctgaagaccgaggtcaccaaccccgcggtgctgcggaagctctgcatcgaggccaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcctgacctgcgccaagttcaagtgcgtgaccaagctggagggcaagatcgtccagtacgagaacctcaagtacagcgtgatcgtgaccgtccacacgggcgaccagcaccaggtggggaacgagaccaccgagcacggcaccatcgcgaccatcacgccccaggcccccacctccgagatccagctgaccgactacggggccctgaccctcgactgcagcccccgcacgggcctggacttcaacgagatggtcctgctcaccatgaaggagaagtcctggctggtgcacaagcagtggttcctggacctcccgctgccctggaccagcggggcctccaccagccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcaccagctacgtcatgtgcacggggtccttcaagctggagaaggaggtggcggagacccagcacggcaccgtgctggtccaggtgaagtacgagggcaccgacgccccctgcaagatccccttcagcacgcaggacgagaagggggtgacccagaacggccggctgatcaccgccaacccgatcgtcaccgacaaggagaagcccgtgaacatcgagacggagccccccttcggggagtcctacatcgtggtcggcgccggcgagaaggcgctcaagctgagctggttcaagaaggggtccagcatcggcaagatgttcgaggccaccgcccgcggggcccggcgcatggccatcctgggcgacaccgcgtgggacttcgggtccatcggcggcgtgttcaccagcgtggggaagctcgtccaccaggtgttcggcacggcctacggggtgctgttctccggcgtcagctggaccatgaagatcgggatcggcatcctgctcacctggctgggcctgaactcccgcagcacctccctcagcatgacgtgcatcgccgtggggatggtgaccctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgactccccgaagcgcctgagcgcggccatcggcaaggcctgggaggagggggtgtgcggcatccggagcgccacgcgcctggagaacatcatgtggaagcagatctccaacgagctcaaccacatcctgctggagaacgacatgaagttcaccgtcgtggtgggggacgccaacggcatcctcgcgcaggggaagaagatgatccggccccagcccatggagcacaagtacagctggaagtcctggggcaaggccaagatcatcggcgccgacatccagaacaccaccttcatcatcgacgggcccgacacgccggagtgccccgacgaccagcgcgcctggaacatctgggaggtcgaggactacggcttcgggatcttcaccaccaacatctggctgaagctgcgggacagctacacccagatgtgcgaccaccgcctcatgtccgcggccatcaaggacagcaaggccgtgcacgccgacatgggctactggatcgagtccgagaagaacgagacgtggaagctggcccgggcgagcttcatcgaggtgaagacctgcacctggcccaagtcccacaccctgtggagcaacggcgtcctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctcccccccctgcgcttccggggggaggacggctgctggtacgggatggagatccgccccgtgaaggagaaggaggagaacctggtccggtccatggtgagcgccggctccggcgaggtggacagcttcagcctcgggatcctgtgcgtctccatcatgatcgaggaggtgatgcgcagccggtggtcccgcaagatgctgatgaccggcaccctcgccgtgttcctgctgctcatcatggggcagctgacctggaacgacctgatccgcctctgcatcatggtcggcgccaacgcgagcgaccggatggggatgggcacgacctacctggccctgatggccaccttcaagatgcgcccgatgttcgccgtgggcatcctcttccggcgcctgacctcccgggaggtgctgctcctgacgatcgggctgagcctcgtcgcctccgtggagctgcccaacagcctggaggagctcggcgacgggctggcgatgggcatcatgatgctgaagctcctgaccgagttccagccccaccagctgtggaccaccctcctgtccctgacgttcatcaagaccaccctcagcctggactacgcctggaagaccacggccatggccctgtccatcgtcagcctcttccccctgtgcctgtccaccaccagccagaagaccacctggctcccggtgctgctgggctccttcgggtgcaagcccctcacgatgttcctgatcaccgagaacaagatctggggccgcaagagctggcccatcaacgaggggatcatggcgatcggcatcgtgtccatcctgctcagctccctgctgaagaacgacgtccccctcgccgggccgctgatcgccggcggcatgctgatcgcctgctacgtgatcagcgggagctccgccgacctcagcctggagaaggcggccgaggtgtcctgggagcaggaggccgagcacagcggcacctcccacaacatcctggtcgaggtgcaggacgacgggaccatgcggatcaaggacgaggagaaggacgacacgctcaccatcctgctgaaggccaccctcctggccgtgagcggcgtctaccccatgtccatccccgcgaccctgttcgtgtggtacttctggcagaagaagaagcagcgcagcggggtgctctgggacacgccctccccgcccgaggtcgagcgggccgtgctggacgacggcatctaccgcatcctgcagcggggcctcctggggcgcagccaggtgggcgtcggggtgttccaggacggcgtgttccacaccatgtggcacgtcacccggggggccgtgctgatgtaccagggcaagcgcctggagccctcctgggccagcgtgaagaaggacctcatctcctacggcgggggctggcggttccaggggagctggaacaccggcgaggaggtccaggtgatcgccgtggagcccgggaagaacccgaagaacgtccagacgacccccggcaccttcaagacctccgagggcgaggtgggggcgatcgccctggacttcaagcccggcacgagcgggtcccccatcgtgaaccgcgagggcaagatcgtcggcctgtacgggaacggcgtggtgaccaccagcgggacctacgtctccgccatcgcccaggccaagacgagccaggagggcccgctccccgagatcgaggacgaggtgttcaagaagcggaacctgaccatcatggacctgcaccccgggagcggcaagacccgccggtacctcccggcgatcgtgcgcgaggccatcaagcggaagctgcgcaccctgatcctcgcccccacgcgcgtcgtggcctccgagatggcggaggccctgaagggcatgcccatccggtaccagaccaccgccgtgaagagcgagcacaccgggcgcgagatcgtcgacctgatgtgccacgccacgttcaccatgcggctcctgtcccccgtgcgcgtgccgaactacaacatgatcatcatggacgaggcccacttcaccgaccccgcgagcatcgccgcccggggctacatctccacccgcgtcgggatgggcgaggccgccgcgatcttcatgacggccaccccccccgggagcgtggaggccttcccgcagtccaacgccgtgatccaggacgaggagcgggacatccccgagcgcagctggaactccggctacgactggatcaccgacttccccggcaagaccgtctggttcgtgcccagcatcaagtccgggaacgacatcgccaactgcctgcggaagaacggcaagcgcgtgatccagctcagccggaagacgttcgacaccgagtaccagaagaccaagaacaacgactgggactacgtcgtgaccacggacatctccgagatgggggcgaacttccgcgccgaccgggtgatcgacccgcgccggtgcctgaagcccgtcatcctgaaggacggccccgagcgcgtgatcctcgccgggcccatgccggtgaccgtcgccagcgcggcccagcggcgcggccggatcggccgcaaccagaacaaggagggggaccagtacgtgtacatgggccagcccctgaacaacgacgaggaccacgcccactggaccgaggccaagatgctgctcgacaacatcaacacccccgaggggatcatccccgccctgttcgagccggagcgcgagaagtccgcggccatcgacggcgagtaccggctgcgcggggaggcccggaagaccttcgtcgagctcatgcgccggggcgacctgcccgtgtggctgagctacaaggtggcctccgagggcttccagtacagcgaccgccggtggtgcttcgacggggagcgcaacaaccaggtcctcgaggagaacatggacgtggagatctggacgaaggagggcgagcggaagaagctgcgcccccggtggctggacgcccgcacctactccgaccccctcgcgctgcgggagttcaaggagttcgccgccgggcgccggagcgtgagcggcgacctgatcctcgagatcggcaagctgccgcagcacctgaccctccgcgcccagaacgccctggacaacctggtcatgctccacaactccgagcaggggggcaaggcgtaccggcacgccatggaggagctgcccgacaccatcgagacgctgatgctcctggccctgatcgccgtgctcaccgggggcgtgaccctgttcttcctgagcgggaagggcctcggcaagacctccatcgggctgctgtgcgtcacggcgagctccgccctcctgtggatggccagcgtggagccccactggatcgccgcctccatcatcctggagttcttcctcatggtgctgctgatccccgagccggaccgccagcggaccccccaggacaaccagctcgcgtacgtcgtgatcggcctgctgttcatgatcctcaccgtggccgccaacgagatggggctgctggagaccacgaagcgcgacctcggcatcgggcacgtcgccgccgagaaccaccagcacgcgaccatgctggacgtggacctgcggcccgccagcgcctggaccctctacgccgtggccaccacggtcatcaccccgatgatgcgccacaccatcgagaacaccacggcgaacatctccctgaccgccatcgccaaccaggccgccatcctgatgggcctcgacaagggctggcccatcagcaagatggacatcggggtgcccctgctggcgctcggctgctactcccaggtgaaccccctgaccctgaccgccgccgtcctcatgctggtggcccactacgcgatcatcgggccgggcctgcaggccaaggccacgcgcgaggcccagaagcggaccgccgcggggatcatgaagaaccccaccgtggacggcatcgtcgccatcgacctcgaccccgtggtgtacgacgccaagttcgagaagcagctgggccagatcatgctgctcatcctgtgcaccagccagatcctgctcatgcgcacgacctgggccctgtgcgagtccatcaccctggccaccgggcccctcacgaccctgtgggagggcagcccggggaagttctggaacaccaccatcgcggtctccatggccaacatcttccggggcagctacctggccggcgccgggctcgccttctccctgatgaagagcctgggcgggggccgccgggggacgggcgcgcagggcgagaccctcggggagaagtggaagcgccagctgaaccagctgtccaagcccgagttcaacacctacaagcggagcggcatcatggaggtggaccgcagcgaggccaaggaggggctcaagcggggcgagaccaccaagcacgccgtgtcccgcgggacggccaagctgcggtggttcgtcgagcgcaacctggtgaagcccgagggcaaggtgatcgacctcggctgcgggcggggcgggtggagctactactgcgcgggcctgaagaaggtcaccgaggtgaaggggtacaccaagggcggccccgggcacgaggagccgatccccatggccacctacggctggaacctggtgaagctgcactccgggaaggacgtcttcttcatgccccccgagaagtgcgacacgctcctgtgcgacatcggcgagagctccccgaaccccaccatcgaggaggggcgcaccctgcgggtgctcaagatggtggagccctggctgcgcggcaaccagttctgcatcaagatcctgaacccctacatgccgagcgtcgtggagaccctcgagcagatgcagcggaagcacggcgggatgctggtgcgcaaccccctgtcccggaacagcacgcacgagatgtactgggtctcctgcggcaccgggaacatcgtgagcgccgtgaacatgacctcccgcatgctcctgaaccgcttcaccatggcccaccggaagcccacgtacgagcgcgacgtcgacctgggcgccggcacccggcacgtggcggtggagcccgaggtcgccaacctcgacatcatcgggcagcgcatcgagaacatcaagaacgagcacaagagcacctggcactacgacgaggacaacccgtacaagacctgggcctaccacggctcctacgaggtgaagcccagcgggtccgccagctccatggtgaacggcgtcgtgcggctgctgacgaagccctgggacgtcatccccatggtgacccagatcgccatgaccgacaccacgccgttcgggcagcagcgcgtgttcaaggagaaggtcgacacccggaccccccgcgcgaagcggggcaccacgcagatcatggaggtgaccgccaagtggctctggggcttcctgagccgcaacaagaagccccggatctgcacccgcgaggagttcacccggaaggtgcgctccaacgccgccatcggggccgtcttcgtggacgagaaccagtggaacagcgcgaaggaggccgtggaggacgagcggttctgggacctggtccaccgcgagcgggagctccacaagcagggcaagtgcgccacgtgcgtgtacaacatgatggggaagcgcgagaagaagctgggcgagttcgggaaggccaagggcagccgggcgatctggtacatgtggctgggcgcccgcttcctcgagttcgaggccctggggttcatgaacgaggaccactggttctcccgggagaacagcctgtccggcgtggagggggagggcctccacaagctggggtacatcctgcgcgacatcagcaagatcccgggcggcaacatgtacgccgacgacaccgccgggtgggacacccgcatcaccgaggacgacctccagaacgaggcgaagatcacggacatcatggagcccgagcacgccctgctggccacctccatcttcaagctcacctaccagaacaaggtcgtgcgggtgcagcgccccgccaagaacggcaccgtcatggacgtgatcagccggcgcgaccagcgggggtccggccaggtgggcacgtacgggctgaacaccttcaccaacatggaggtccagctgatccgccagatggagagcgagggcatcttcctcccctccgagctggagaccccgaacctggccgagcgggtgctcgactggctggagaagcacggggcggagcgcctgaagcggatggccatcagcggcgacgactgcgtggtcaagcccatcgacgaccgcttcgccaccgccctcacggccctgaacgacatggggaaggtgcggaaggacatcccccagtgggagccctccaagggctggaacgactggcagcaggtgccgttctgcagccaccacttccaccagctgatcatgaaggacggccgcgagatcgtcgtgccctgccggaaccaggacgagctcgtggggcgcgcgcgggtctcccagggcgccgggtggagcctgcgcgagaccgcctgcctgggcaagtcctacgcccagatgtggcagctcatgtacttccaccggcgcgacctgcggctggccgcgaacgccatctgcagcgccgtgcccgtggactgggtccccacctcccgcaccacgtggagcatccacgcccaccaccagtggatgaccaccgaggacatgctcagcgtgtggaaccgcgtgtggatcgaggagaacccgtggatggaggacaagacccacgtctccagctgggaggaggtgccctacctggggaagcgggaggaccagtggtgcggctccctgatcggcctcacggcgcgcgccacctgggccaccaacatccaggtggccatcaaccaggtccggcgcctgatcgggaacgagaactacctggactacatgaccagcatgaagcggttcaagaacgagtccgaccccgagggcgccctctggtga

SEQ ID NO: 8172 - RNA, 9879 nt, synthetic construct
  misc_feature 1..9879: note = derived and/or modified CDS sequence (opt1) from DENV-1__KF973471__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacacgatgacctacaagtgcccccagatcaccgaggccgagcccgacgacgtggactgctggtgcaacgccaccgacacgtgggtcacctacgggacctgcagccagaccggcgagcaccggcgggacaagcgctccgtggccctggcgccccacgtgggcctggggctcgagacgcggaccgagacctggatgagcagcgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgcgagctgaagtgcgggtccggcatcttcgtgaccaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtggtcgtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacaaccagcgggcctggaacatctgggaggtggaggactacggcttcgggatcttcacgaccaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacgtgcacctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgccagcatcatgatcgaggaggtgatgcggtcccgctggagccggaagatgctcatgacgggcaccccggccgtcttcctgctgctcatcatggggcagctgacctggaacgacctgatccgcctctgcatcatggtgggcgcgaacgcctccgaccgcatggggatgggcaccacgtacctggccctgatggccaccttcaagatgcggcccatgttcgccgtgggcctcctgttccgccggctgaccagccgcgaggtcctcctgctgaccatcgggctctccctggtggcgagcgtggagctgcccaactccctcgaggagctgggcgacgggctggccatgggcatcatgatgctcaagctgctgacggagttccagccccaccagctctggaccaccctgctgagcctcaccttcatcaagacgaccctgtccctggactacgcctggaagaccaccgccatggcgctcagcatcatctccctgttcccgctgtgcctcagcacgacctcccagaagaccacctggctgcccgtcctgctcggcagcttcgggtgcaagcccctgaccatgttcctgatcacggagaacaagatctggggccggaagtcctggcccctcaacgaggggatcatggccatcggcatcgtgagcatcctgctgtccagcctcctgaagaacgacgtcccgctggccgggcccctcaccgccggcggcatgctgatcgcctgctacgtgatcagcgggtccagcgcggacctgtccctcgagaaggccgccgaggtgagctgggagcaggaggccgagcactccggcaccagccacaacatcctggtcgaggtgcaggacgacgggaccatgaagatcaaggacgaggagcgcgacgacacgctgaccatcctcctgaaggccaccctgctcgcggtgtccggcgtctaccccatgagcatccccgccaccctgttcgtgtggtacttctggcagaagaagaagcagcggtccggggtgctgtgggacacgccgtccccgcccgaggtcgagcgcgccgtgctcgacgacggcatctaccggatcctgcagcgcggcctgctggggcggtcccaggtgggcgtcggggtgttccaggacggcgtgttccacaccatgtggcacgtcacccgcggggccgtgctcatgtaccagggcaagcggctggagcccagctgggcctccgtgaagaaggacctgatcagctacggcgggggctggcgcttccaggggtcctggaacaccggcgaggaggtccaggtgatcgcggtggagccggggaagaaccccaagaacgtccagacgacccccggcaccttcaagacccccgagggcgaggtgggggccatcgccctcgacttcaagccgggcacgagcgggtcccccatcgtgaaccgggagggcaagatcgtcggcctgtacgggaacggcgtggtgaccaccagcgggacctacgtctccgccatcgcccaggcgaaggccagccaggagggccccctgccggagatcgaggacgaggtgttcaagaagcgcaacctcacgatcatggacctgcaccccgggagcggcaagacccggcgctacctgcccgccatcgtgcgggaggccatcaagcgcaagctccggaccctgatcctggcgcccacccgcgtcgtggcctccgagatggccgaggccctcaagggcatgccgatccgctaccagacgaccgccgtcaagagcgagcacaccgggcgggagatcgtcgacctgatgtgccacgcgaccttcacgatgcgcctgctctcccccgtgcgggtgcccaactacaacatgatcatcatggacgaggcccacttcaccgaccccgccagcatcgccgcccgcggctacatctccacccgggtcgggatgggcgaggcggccgccatcttcatgaccgccacgccgcccgggagcgtggaggccttcccccagtccaacgcggtgatccaggacgaggagcgcgacatccccgagcggagctggaactccggctacgactggatcaccgacttcccgggcaagaccgtctggttcgtgcccagcatcaagtccgggaacgacatcgccaactgcctgcgcaagaacggcaagcgggtgatccagctgagccgcaagaccttcgacacggagtaccagaagaccaagaacaacgactgggactacgtcgtgaccaccgacatctccgagatgggggccaacttccgggccgaccgcgtgatcgacccccggcgctgcctcaagcccgtcatcctgaaggacggcccggagcgggtgatcctggcggggcccatgcccgtgacggtcgccagcgccgcccagcgccggggccgcatcggccggaaccagaacaaggagggggaccagtacgtgtacatgggccagcccctcaacaacgacgaggaccacgcccactggaccgaggcgaagatgctgctggacaacatcaacaccccggaggggatcatccccgccctcttcgagcccgagcgcgagaagtccgccgccatcgacggcgagtaccgcctgcgcggggaggcccgcaagaccttcgtggagctgatgcggcgcggcgacctccccgtctggctgagctacaaggtggcgtccgagggcttccagtacagcgaccggcgctggtgcttcgacggggagcggaacaaccaggtcctggaggagaacatggacgtggagatctggaccaaggagggcgagcgcaagaagctccggccgcgctggctggacgcccggacgtactccgaccccctggccctccgcgagttcaaggagttcgccgccgggcggcgcagcgtgagcggcgacctgatcctggagatcggcaagctcccccagcacctgaccctgcgggcgcagaacgccctcgacaacctggtcatgctgcacaactccgagcagggcgggaaggcctaccgccacgccatggaggagctccccgacaccatcgagaccctgatgctgctcgcgctgatcgccgtgctgaccggcggggtgaccctcttcttcctgagcgggaaggggctgggcaagacctccatcgggctcctgtgcgtcaccgccagctccgccctgctctggatggccagcgtggagccgcactggatcgcggcctccatcatcctggagttcttcctgatggtgctcctgatccccgagcccgaccggcagcgcacgccgcaggacaaccagctggcctacgtcgtgatcggcctcctgttcatgatcctgaccgtggccgccaacgagatggggctcctggagaccaccaagaaggacctgggcatcgggcacgtcgcggccgagaaccaccagcacgccacgatgctcgacgtggacctgcggcccgccagcgcctggaccctgtacgcggtggccaccaccgtcatcacgcccatgatgcgccacaccatcgagaacaccaccgccaacatctccctcacggccatcgccaaccaggcggccatcctgatgggcctggacaagggctggcccatcagcaagatggacatcggggtgccgctcctggccctgggctgctactcccaggtgaaccccctcaccctgaccgccgcggtcctgatgctcgtggcccactacgccatcatcgggcccggcctgcaggccaaggccacccgggaggcgcagaagcgcacggccgccgggatcatgaagaaccccaccgtggacggcatcgtcgccatcgacctggacccggtggtgtacgacaccaagttcgagaagcagctcggccagatcatgctgctgatcctctgcaccagccagatcctgctgatgcgcacgacctgggccctctgcgagtccatcaccctggcgaccgggcccctgacgaccctctgggagggcagccccgggaagttctggaacaccaccatcgccgtctccatggccaacatcttccggggcagctacctggccggcgccgggctggcgttctccctcatgaagtccctgggcgggggccgccgggggacgggcgcccagggcgagaccctgggggagaagtggaagcgccagctcaaccagctgtccaagagcgagttcaacatctacaagcggagcggcatcatggaggtggaccgctccgaggccaaggaggggctgaagcggggcgagaccaccaagcacgccgtgagccgcgggaccgcgaagctccggtggttcgtcgagcgcaacctggtgaagcccgagggcaaggtgatcgacctgggctgcgggcggggcgggtggtcctactactgcgccggcctgaagaaggtcacggaggtgaaggggtacaccaagggcggcccggggcacgaggagcccatccccatggccacctacggctggaacctcgtgaagctgcacagcgggaaggacgtcttcttcatgcccccggagaagtgcgacaccctgctctgcgacatcggcgagtccagccccaaccccacggtggaggaggggcgcaccctgcgggtgctgaagatggtcgagccctggctcaagggcaaccagttctgcatcaagatcctgaacccgtacatgccctccgtggtggagaccctggagcagatgcagcgcaagtacggcgggatgctcgtccggaaccccctgagccgcaactccacccacgagatgtactgggtgagctgcggcacggggaacatcgtgtccgccgtcaacatgaccagccggatgctgctcaaccgcttcaccatggcccaccggaagcccacctacgagcgcgacgtggacctgggcgcgggcacgcgccacgtggccgtcgagccggaggtggccaacctggacatcatcgggcagcggatcgagaacatcaagaacgagcacaagtccacctggcactacgacgaggacaacccctacaagacctgggcctaccacggcagctacgaggtgaagccctccgggagcgcctccagcatggtcaacggcgtggtgcgcctcctgaccaagccctgggacgtcatcccgatggtgacgcagatcgcgatgaccgacaccacccccttcgggcagcagcgggtcttcaaggagaaggtggacacgcgcacgccccgggccaagcgcggcaccacccagatcatggaggtgacggccaagtggctgtggggcttcctctcccggaacaagaagccgcgcatctgcacccgggaggagttcacccgcaaggtccggagcaacgccgccatcggggcggtgttcgtggacgagaaccagtggaacagcgccaaggaggccgtcgaggacgagcgcttctgggacctggtgcaccgggagcgcgagctgcacaagcagggcaagtgcgcgacctgcgtgtacaacatgatggggaagcgggagaagaagctcggcgagttcgggaaggcgaagggctcccgcgccatctggtacatgtggctgggcgcccggttcctggagttcgaggccctcgggttcatgaacgaggaccactggttcagccgcgagaactccctgagcggcgtcgagggggagggcctgcacaagctcgggtacatcctgcgggacatctccaagatccccggcggcaacatgtacgccgacgacacggcggggtgggacacccgcatcaccgaggacgacctgcagaacgaggccaagatcaccgacatcatggagcccgagcacgccctcctggccacgagcatcttcaagctgacctaccagaacaaggtggtgcgggtccagcgccccgccaagaacggcaccgtgatggacgtgatctcccgccgggaccagcgcgggagcggccaggtcggcacctacgggctcaacacgttcaccaacatggaggtgcagctgatccggcagatggagtccgagggcatcttcctgccgagcgagctcgagacccccaacctggcggagcgcgtgctggactggctcgagaagcacggggccgagcggctgaagcgcatggccatctccggcgacgactgcgtcgtgaagcccatcgacgaccggttcgccaccgccctgaccgcgctcaacgacatggggaaggtgcgcaaggacatcccccagtgggagccgagcaagggctggaacgactggcagcaggtccccttctgctcccaccacttccaccagctgatcatgaaggacggccgggagatcgtggtgccctgccgcaaccaggacgagctggtcgggcgggcccgcgtgagccagggcgccgggtggtccctccgggagacggcctgcctgggcaagagctacgcccagatgtggcagctgatgtacttccaccgccgggacctccgcctggcggccaacgccatctgctccgccgtgcccgtcgactgggtgccgaccagccggaccacctggagcatccacgcgcaccaccagtggatgacgaccgaggacatgctgtccgtgtggaaccgcgtctggatcgaggagaacccctggatggaggacaagacccacgtgagctcctgggaggaggtgccctacctcgggaagcgggaggaccagtggtgcggcagcctgatcggcctgaccgcccgcgccacgtgggccaccaacatccaggtcgccatcaaccaggtgcgccggctcatcgggaacgagaactacctggactacatgacctccatgaagcgcttcaagaacgagagcgaccccgagggcgcgctgtggtga

SEQ ID NO: 8173 - RNA, 9879 nt, synthetic construct
  misc_feature 1..9879: note = derived and/or modified CDS sequence (opt1) from DENV-1__KF973472__SS-prME
  source 1..9879: mol_type = other RNA
agcgtgaccatgctcctcatgctgctgcccaccgccctcgccttccacctgaccacccggggcggggagccgcacatgatcgtgagcaagcacgagcggggcaagagcctcctgttcaagaccagcaccggggtgaacatgtgcacgctgatcgccatggacctgggcgagctctgcgaggacaccatgacctacaagtgcccccgcatcaccgaggccgagcccgacgacgtggactgctggtgcaacgccacggacacctgggtgacctacgggacctgcagccagacgggcgagcaccggcgcgacaagcggtccgtggccctggcgccccacgtgggcctggggctcgagacccgcaccgagacctggatgagctccgagggcgcgtggaagcagatccagcgggtcgagacgtgggccctgcgccaccccgggttcaccgtgatcgccctgttcctcgcccacgcgatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgccgtgctccggaagctgtgcatcgaggcgaagatcagcaacaccacgaccgactcccgctgcccgacccagggcgaggccaccctggtggaggagcaggacgccaacttcgtctgccggcgcacgctcgtggaccggggctgggggaacggctgcgggctgttcggcaaggggagcctgctgacctgcgccaagttcaagtgcgtgaccaagctggagggcaagatcgtccagtacgagaacctgaagtactccgtgatcgtgaccgtccacacgggcgaccagcaccaggtggggaacgagaccaccgagcacggcaccatcgccaccatcacgccccaggcgcccaccagcgagatccagctcaccgactacggggccctggccctggactgcagcccccggaccggcctcgacttcaacgagatggtcctgctgacgatgaaggagaagtcctggctcgtgcacaagcagtggttcctggacctgccgctcccctggacctccggggccagcaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcacctcctacgtcatgtgcaccgggagcttcaagctggagaaggaggtggcggagacgcagcacggcaccgtgctcgtccaggtgaagtacgagggcaccgacgccccctgcaagatccccttctccacccaggacgagaagggggtgacgcagaacggccggctgatcaccgccaacccgatcgtcaccgacaaggagaagcccgtgaacatcgagaccgagccgcccttcggggagagctacatcgtggtcggcgccggcgagaaggcgctgaagctctcctggttcaagaaggggagctccatcggcaagatgttcgaggccacggcccgcggggcccggcgcatggccatcctgggcgacaccgcgtgggacttcgggagcatcggcggcgtgttcacctccgtggggaagctggtccaccaggtgttcggcaccgcctacggggtcctcttcagcggcgtctcctggacgatgaagatcgggatcggcatcctgctgacctggctcggcctgaacagccgctccaccagcctgtccgtgacctgcatcgccgtggggatggtcacgctctacctgggcgtgatggtgcaggccgacagcgggtgcgtcatcaactggaagggccgggagctgaagtgcgggtccggcatcttcgtgaccaacgaggtgcacacctggaccgagcagtacaagttccaggccgacagcccgaagcgcctcagcgcggccatcggcaaggcctgggaggagggggtctgcggcatccggtccgccacccgcctggagaacatcatgtggaagcagatcagcaacgagctgaaccacatcctcctggagaacgacatgaagttcacggtggtggtcggggacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacgaccagcgcgcctggaacatctgggaggtggaggactacggcttcgggatcttcacgaccaacatctggctcaagctgcgggactcctacacccagatgtgcgaccaccgcctgatgagcgcggccatcaaggactccaaggccgtgcacgccgacatgggctactggatcgagagcgagaagaacgagacctggaagctcgcccgggcgtccttcatcgaggtcaagacgtgcacctggcccaagagccacaccctgtggtccaacggcgtgctggagagcgagatgatcatccccaagatctacgggggcccgatctcccagcacaactaccgccccgggtacttcacccagacggccggcccctggcacctcgggaagctggagctggacttcgacctctgcgagggcaccaccgtggtcgtggacgagcactgcggcaaccgggggccgagcctgcgcaccacgaccgtgaccggcaagatcatccacgagtggtgctgccggtcctgcaccctgccgcccctccgcttccgcggggaggacggctgctggtacgggatggagatccgccccgtcaaggagaaggaggagaacctggtgcggagcatggtgtccgccggcagcggcgaggtcgacagcttctccctggggatcctctgcgtgagcatcatgatcgaggaggtgatgcgctcccggtggagccgcaagatgctgatgacgggcaccctggccgtcttcctcctgctgatcatggggcagctcacctggaacgacctgatccgcctgtgcatcatggtgggcgccaacgcgtccgaccggatggggatgggcaccacgtacctcgccctgatggccaccttcaagctgcgcccgatgttcgccgtgggcatcctcttccggcgcctgaccagccgggaggtcctgctcctgaccatcgggctgtccctcgtggccagcgtcgagctgcccaactccctggaggagctcggcgacgggctggcgatgggcatcatgatgctgaagctcctgacggagttccagccccaccagctgtggaccaccctcctgagcctgaccttcatccgcacgaccctctccctggactacgcctggaagaccaccgccatggccctgagcatcgtgtccctcttccccctgtgcctgagcacgacctcccagaagaccacctggctcccggtgctgctgggcagcttcgggtgcaagcccctcaccatgtacttcatcacggagaacaagatctggggccggaagtcctggcccatcaacgaggggatcatggcgatcggcatcgtcagcatcctgctgtccagcctcctgaagaacgacgtgcccctggccgggccgctcatcgccggcggcatgctgatcgcctgctacgtgatcagcgggtccagcgccgacctgtccctcgagaaggcggccgaggtcagctgggagcaggaggccgagcactccggcaccagccacaacatcctggtggaggtgcgcgacgacgggaccatgcggatcaaggacgaggagaaggacgacaccctgacgatcctcctgaaggccaccctgctcgccgtctccggcgtgtaccccatgagcatccccgcgaccctgttcgtgtggtacttctggcagaagaagaagcagcgctccggggtcctgtgggacacccccagcccgcccgaggtggagcgggccgtgctcgacgacggcatctaccgcatcctgcagcggggcctgctggggcgctcccaggtcggcgtgggggtgttccaggacggcgtcttccacacgatgtggcacgtgacccgcggggccgtgctcatgtaccagggcaagcgcctggagcccagctgggcctccgtcaagaaggacctgatcagctacggcgggggctggcggttccaggggtcctggaacaccggcgaggaggtccaggtgatcgccgtcgagcccgggaagaacccgaagaacgtgcagaccacgcccggcaccttcaagacccccgagggcgaggtgggggcgatcgccctcgacttcaagcccggcaccagcgggtccccgatcgtcaaccgcgagggcaagatcgtgggcctgtacgggaacggcgtggtcacgaccagcgggacctacgtgtccgccatcgcccaggccaaggcgagccaggagggccccctgcccgagatcgaggacgaggtgttcaagaagcggaacctcaccatcatggacctgcacccggggagcggcaagacgcgccggtacctgcccgccatcgtccgcgaggccatcaagcgcaagctccggaccctgatcctggcccccacccgcgtggtggcgtccgagatggccgaggccctcaagggcatgcccatccggtaccagaccacggccgtcaagagcgagcacaccgggcgcgagatcgtggacctgatgtgccacgccaccttcaccatgcggctgctctccccggtgcgcgtccccaactacaacatgatcatcatggacgaggcgcacttcacggaccccgccagcatcgccgcccggggctacatctccacccgcgtggggatgggcgaggccgcggccatcttcatgaccgccacgccgcccgggagcgtggaggccttcccccagtccaacgccgtcatccaggacgaggagcgggacatccccgagcgcagctggaactccggctacgactggatcacggacttccccggcaagaccgtgtggttcgtgcccagcatcaagtccgggaacgacatcgcgaactgcctgcggaagaacggcaagcgcgtcatccagctgagccggaagaccttcgacaccgagtaccagaagacgaagaacaacgactgggactacgtggtgaccaccgacatctccgagatgggggccaacttccgcgccgaccgggtcatcgacccccgccggtgcctcaagcccgtgatcctgaaggacggccccgagcgcgtgatcctggccgggccgatgcccgtcaccgtggcgagcgccgcccagcggcgcggccgcatcggccggaaccagaacaaggagggggaccagtacgtctacatgggccagcccctcaacaacgacgaggaccacgcccactggacggaggccaagatgctgctggacaacatcaacacccccgaggggatcatcccggccctcttcgagcccgagcgcgagaagtccgccgccatcgacggcgagtaccggctgcgcggggaggcccggaagaccttcgtggagctgatgcgccggggcgacctccccgtgtggctgagctacaaggtcgcctccgagggcttccagtacagcgaccgccggtggtgcttcgacggggagcgcaacaaccaggtgctggaggagaacatggacgtggagatctggaccaaggagggcgagcggaagaagctccgcccccggtggctggacgcgcgcacctactccgacccgctggccctccgggagttcaaggagttcgccgccgggcgccggagcgtcagcggcgacctgatcctggagatcggcaagctcccccagcacctgacgctgcgcgcccagaacgcgctcgacaacctggtgatgctgcacaactccgagcagggcgggaaggcctaccggcacgccatggaggagctccccgacaccatcgagaccctgatgctgctcgccctgatcgcggtgctgaccgggggcgtcaccctcttcttcctgagcgggaagggcctgggcaagacctccatcgggctcctgtgcgtgaccgccagctccgccctgctctggatggccagcgtggagccccactggatcgccgcgtccatcatcctggagttcttcctgatggtcctcctgatcccggagcccgaccgccagcggacgccccaggacaaccagctggcctacgtggtgatcggcctcctgttcatgatcctgacggtcgccgccaacgagatggggctcctggagaccaccaagcgcgacctgggcatcgggcacgtggccgcggagaaccaccagcacgccaccatgctcgacgtggacctgcgcccggccagcgcctggacgctgtacgccgtcgcgaccaccgtgatcacccccatgatgcggcacacgatcgagaacaccaccgccaacatctccctcaccgccatcgccaaccaggccgcgatcctgatgggcctggacaagggctggcccatcagcaagatggacatcggggtgcccctcctggccctgggctgctactcccaggtcaacccgctcacgctgaccgccgccgtgctgatgctcgtggcgcactacgccatcatcgggcccggcctgcaggccaaggccacccgcgaggcccagaagcggaccgcggccgggatcatgaagaaccccacggtcgacggcatcgtggccatcgacctggaccccgtggtctacgacgccaagttcgagaagcagctcggccagatcatgctgctgatcctctgcaccagccagatcctgctgatgcgcaccacctgggccctctgcgagtccatcacgctggcgaccgggccgctgaccaccctctgggagggcagccccgggaagttctggaacacgaccatcgccgtgtccatggccaacatcttccggggcagctacctggccggcgccgggctggcgttctccctcatgaagtccctgggcgggggccgccgggggaccggcgcccagggcgagaccctgggggagaagtggaagcgccagctcaaccagctgtccaagcccgagttcaacacgtacaagcggagcggcatcatggaggtggaccgcagcgaggccaaggaggggctgaagcggggcgagaccaccaagcacgccgtctcccgcgggaccgcgaagctccggtggttcgtggagcgcaacctggtgaagcccgagggcaaggtcatcgacctgggctgcgggcggggcgggtggagctactactgcgccggcctgaagaaggtgaccgaggtgaaggggtacacgaagggcggcccggggcacgaggagcccatccccatggccacctacggctggaacctcgtcaagctgcactccgggaaggacgtgttcttcatgcccccggagaagtgcgacaccctgctctgcgacatcggcgagagctcccccaaccccaccatcgaggaggggcgcacgctgcgggtgctgaagatggtcgagccctggctccgcggcaaccagttctgcatcaagatcctgaacccgtacatgcccagcgtggtggagaccctggagcagatgcagcggaagcacggcgggatgctcgtccgcaaccccctgtcccgcaacagcacccacgagatgtactgggtgtcctgcggcaccgggaacatcgtgagcgccgtcaacatgacgtcccggatgctgctcaaccgcttcaccatggcccaccggaagcccacctacgagcgcgacgtggacctgggcgcgggcacccggcacgtggccgtcgagccggaggtggccaacctggacatcatcgggcagcgcatcgagaacatcaagaacgagcacaagagcacgtggcactacgacgaggacaacccctacaagacctgggcctaccacggctcctacgaggtgaagcccagcgggtccgccagctccatggtcaacggcgtggtccggctcctgaccaagccctgggacgtgatcccgatggtgacccagatcgcgatgacggacaccacccccttcgggcagcagcgcgtcttcaaggagaaggtggacacccggacgccccgcgccaagcggggcaccacccagatcatggaggtgaccgccaagtggctgtggggcttcctcagccgcaacaagaagccgcggatctgcacgcgcgaggagttcacccggaaggtccgctccaacgccgccatcggggcggtgttcgtggacgagaaccagtggaacagcgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggcgaagggcagccgggccatctggtacatgtggctgggcgcccgcttcctggagttcgaggccctcgggttcatgaacgaggaccactggttctcccgcgagaacagcctgtccggcgtcgagggggagggcctgcacaagctcgggtacatcctgcgggacatcagcaagatccccggcggcaacatgtacgccgacgacaccgcggggtgggacacgcgcatcaccgaggacgacctgcagaacgaggccaagatcaccgacatcatggagcccgagcacgccctcctggccacctccatcttcaagctgacgtaccagaacaaggtggtgcgggtccagcgccccgccaagaacggcaccgtgatggacgtgatcagccggcgcgaccagcgggggtccggccaggtcggcacctacgggctcaacaccttcacgaacatggaggtgcagctgatccgccagatggagagcgagggcatcttcctgccgtccgagctcgagacccccaacctggcggagcgggtgctggactggctcgagaagcacggggccgagcgcctgaagcggatggccatcagcggcgacgactgcgtcgtgaagcccatcgacgaccgcttcgccaccgccctgaccgcgctcaacgacatggggaaggtgcggaaggacatcccccagtgggagccgtccaagggctggaacgactggcagcaggtccccttctgcagccaccacttccaccagctgatcatgaaggacggccgcgagatcgtggtgccctgccggaaccaggacgagctggtcgggcgcgcccgggtgtcccagggcgccgggtggagcctccgcgagaccgcctgcctgggcaagtcctacgcccagatgtggcagctgatgtacttccaccggcgcgacctccgcctggcggccaacgccatctgcagcgccgtgcccgtcgactgggtgccgacgtcccggaccacctggagcatccacgcgcaccaccagtggatgaccacggaggacatgctgagcgtgtggaaccgcgtctggatcgaggagaacccctggatggaggacaagacccacgtgtccagctgggaggaggtgccctacctcgggaagcgggaggaccagtggtgcggctccctgatcggcctgaccgcccgcgccacctgggccacgaacatccaggtcgccatcaaccaggtgcggcgcctcatcgggaacgagagctacctggactacatgacctccatgaagcggttcaagaacgagagcgaccccgagggcgcgctgtggtga

SEQ ID NO: 8174 - RNA, 9879 nt, synthetic construct
  misc_feature 1..9879: note = derived and/or modified CDS sequence (opt1) from DENV-1__KF973474__SS-prME
  source 1..9879: mol_type = other RNA
agcgtgaccatgctcctcatgctgctgcccaccgccctcgccttccacctgaccacccgcggcggggagccgcacatgatcgtgagcaagcacgagcggggcaagagcctcctgttcaagaccagcaccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagacgggcgagcaccggcgcgacaagcggtccgtggccctggcgccccacgtgggcctggggctcgagacccgcaccgagacctggatgagctccgagggcgcctggaagcagatccagcgggtcgagacgtgggccctgcgccaccccgggttcaccgtgatcgccctgttcctcgcccacgcgatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgccgtgctccggaagctgtgcatcgaggcgaagatcagcaacaccacgaccgactcccgctgcccgacccagggcgaggccaccctggtggaggagcaggacgccaacttcgtctgccggcgcacgctcgtggaccggggctgggggaacggctgcgggctgttcggcaaggggagcctgctgacctgcgccaagttcaagtgcgtgaccaagctggagggcaagatcgtccagtacgagaacctgaagtactccgtgatcgtgaccgtccacacgggcgaccagcaccaggtggggaacgagaccaccgagcacggcaccatcgccaccatcacgccccaggcgcccaccagcgagatccagctcaccgactacggggccctggccctggactgcagcccccggaccggcctcgacttcaacgagatggtcctgctgacgatgaaggagaagtcctggctcgtgcacaagcagtggttcctggacctgccgctcccctggacctccggggccagcaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcacctcctacgtcatgtgcaccgggagcttcaagctggagaaggaggtggcggagacgcagcacggcaccgtgctcgtccaggtgaagtacgagggcaccgacgccccctgcaagatccccttctccacccaggacgagaagggggtgacgcagaacggccggctgatcaccgccaacccgatcgtcaccgacaaggagaagcccgtgaacatcgagaccgagccgcccttcggggagagctacatcgtggtcggcgccggcgagaaggcgctgaagctctcctggttcaagaaggggagctccatcggcaagatgttcgaggccacggcccgcggggcccggcgcatggccatcctgggcgacaccgcgtgggacttcgggagcatcggcggcgtgttcacctccgtggggaagctggtccaccaggtgttcggcaccgcctacggggtcctcttcagcggcgtctcctggacgatgaagatcgggatcggcatcctgctgacctggctcggcctgaacagccgctccaccagcctgtccatgacctgcatcgccgtggggatggtgacgctctacctgggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctcagcgcggccatcggcaaggcctgggaggagggggtgtgcggcatccggtccgccacccgcctggagaacatcatgtggaagcagatcagcaacgagctgaaccacatcctcctggagaacgacatgaagttcacggtcgtggtgggggacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacgaccagcgcgcctggaacatctgggaggtcgaggactacggcttcgggatcttcacgaccaacatctggctcaagctgcgggactcctacacccagatgtgcgaccaccgcctgatgagcgcggccatcaaggactccaaggccgtgcacgccgacatgggctactggatcgagagcgagaagaacgagacctggaagctcgcccgggcgtccttcatcgaggtgaagacgtgcacctggcccaagagccacaccctgtggtccaacggcgtcctggagagcgagatgatcatccccaagatctacgggggcccgatctcccagcacaactaccgccccgggtacttcacccagacggccggcccctggcacctcgggaagctggagctggacttcgacctctgcgagggcaccaccgtggtggtcgacgagcactgcggcaaccgggggccgagcctgcgcaccacgaccgtgaccggcaagatcatccacgagtggtgctgccggtcctgcaccctgccgcccctccgcttccgcggggaggacggctgctggtacgggatggagatccgccccgtgaaggagaaggaggagaacctggtccggagcatggtgtccgccggcagcggcgaggtggacagcttctccctggggatcctctgcgtcagcatcatgatcgaggaggtgatgcgctcccggtggagccgcaagatgctgatgacgggcaccctggccgtgttcctcctgctgatcatggggcagctcacctggaacgacctgatccgcctgtgcatcatggtcggcgccaacgcgtccgaccggatggggatgggcaccacgtacctcgccctgatggccaccttcaagctgcgcccgatgttcgccgtgggcatcctcttccggcgcctgaccagccgggaggtgctgctcctgaccatcgggctgtccctcgtcgccagcgtggagctgcccaactccctggaggagctcggcgacgggctggcgatgggcatcatgatgctgaagctcctgacggagttccagccccaccagctgtggaccaccctcctgagcctgaccttcatcaagacgaccctctccctggactacgcctggaagaccaccgccatggccctgagcatcgtctccctcttccccctgtgcctgagcacgacctcccagaagaccacctggctcccggtgctgctgggcagcttcgggtgcaagcccctcaccatgtacctgatcacggagaacaagatctggggccgcaagtcctggcccatcaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgcggatcaaggacgaggagaaggacgacaccctcacgatcctgctgaaggccaccctcctggccgtgtccggcgtctaccccatgagcatccccgcgaccctgttcgtgtggtacttctggcagaagaagaagcagcgctccggggtgctctgggacacccccagcccgcccgaggtcgagcgggccgtgctggacgacggcatctaccgcatcctgcagcggggcctgctcgggcgctcccaggtgggcgtcggggtgttccaggacggcgtgttccacacgatgtggcacgtcacccgcggggccgtgctgatgtaccagggcaagcgcctggagcccagctgggcctccgtgaagaaggacctcatcagctacggcgggggctggcggttccaggggtcctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcaccagcgggtccccgatcgtgaaccgcgagggcaagatcgtcggcctgtacgggaacggcgtggtgacgaccagcgggacctacgtctccgccatcgcccaggccaaggcgagccaggagggccccctccccgagatcgaggacgaggtgttcaagaagcggaacctgaccatcatggacctgcacccggggagcggcaagacgcgccggtacctccccgccatcgtgcgcgaggccatcaagcggaagctgcgcaccctgatcctcgcccccacccgcgtcgtggcgtccgagatggccgaggccctgaagggcatgcccgtgcggtaccagaccacggccgtcaagagcgagcacaccgggcgcgagatcgtggacctgatgtgccacgccaccttcaccatgcggctcctgtccccggtgcgcgtccccaactacaacatgatcatcatggacgaggcgcacttcacggaccccgccagcatcgccgcccggggctacatctccacccgcgtggggatgggcgaggccgcggccatcttcatgaccgccacgccgcccgggagcgtggaggccttcccccagtccaacgccgtcatccaggacgaggagcgggacatccccgagcgcagctggaactccggctacgactggatcacggacttccccggcaagaccgtgtggttcgtgcccagcatcaagtccgggaacgacatcgcgaactgcctgcggaagaacggcaagcgcgtcatccagctcagccggaagaccttcgacaccgagtaccagaagacgaagaacaacgactgggactacgtggtgaccaccgacatctccgagatgggggccaacttccgcgccgaccgggtcatcgacccccgccggtgcctgaagcccgtgatcctgaaggacggccccgagcgcgtgatcctcgccgggccgatgcccgtcaccgtggcgagcgccgcccagcggcgcggccggatcggccgcaaccagaacaaggagggggaccagtacgtctacatgggccagcccctgaacaacgacgaggaccacgcccactggacggaggccaagatgctgctcgacaacatcaacacccccgaggggatcatcccggcgctgttcgagcccgagcgcgagaagtccgccgccatcgacggcgagtaccggctgcgcggggaggcccggaagaccttcgtggagctcatgcgccggggcgacctgcccgtgtggctgagctacaaggtcgcctccgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcgcgcacctactccgacccgctcgccctgcgggagttcaaggagttcgccgccgggcgccggagcgtcagcggcgacctgatcctcgagatcggcaagctgccccagcacctgacgctccgcgcccagaacgcgctggacaacctggtgatgctccacaactccgagcagggcgggaaggcctaccggcacgccatggaggagctgcccgacaccatcgagaccctgatgctcctggccctgatcgcggtgctcaccgggggcgtcacgctgttcttcctgagcgggaagggcctcggcaagacctccatcgggctgctgtgcgtgaccgccagctccgccctcctgtggatggccagcgtggagccccactggatcgccgcgtccatcatcctggagttcttcctcatggtcctgctgatcccggagcccgaccgccagcggacgccccaggacaaccagctcgcctacgtggtgatcggcctgctgttcatgatcctcacggtcgccgccaacgagatggggctgctggagaccaccaagcgcgacctcggcatcgggcacgtggccgcggagaaccaccagcacgccaccatgctggacgtggacctgcggccggccagcgcctggacgctctacgccgtcgcgaccaccgtgatcacccccatgatgcgccacacgatcgagaacaccaccgccaacatctccctgaccgccatcgccaaccaggccgcgatcctgatgggcctcgacaagggctggcccatcagcaagatggacatcggggtgcccctgctggccctcggctgctactcccaggtcaacccgctgacgctgaccgccgccgtgctcatgctggtggcgcactacgccatcatcgggcccggcctgcaggccaaggccacccgcgaggcccagaagcggaccgcggccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcgcaccacctgggccctgtgcgagtccatcacgctggcgaccgggccgctcaccaccctgtgggagggcagccccgggaagttctggaacacgaccatcgccgtgtccatggccaacatcttccggggcagctacctggccggcgccgggctcgcgttctccctgatgaagtccctgggcgggggccgccgggggaccggcgcccagggcgagaccctcggggagaagtggaagcgccagctgaaccagctgtccaagcccgagttcaacacgtacaagcggagcggcatcatggaggtggaccgcagcgaggccaaggaggggctcaagcggggcgagaccaccaagcacgccgtctcccgcgggaccgcgaagctgcggtggttcgtggagcgcaacctggtgaagcccgagggcaaggtcatcgacctgggctgcgggcggggcgggtggagctactactgcgccggcctcaagaaggtgaccgaggtgaaggggtacacgaagggcggcccggggcacgaggagcccatccccatggccacctacggctggaacctggtcaagctgcactccgggaaggacgtgttcttcatgcccccggagaagtgcgacaccctcctgtgcgacatcggcgagagctcccccaaccccaccatcgaggaggggcgcacgctgcgggtgctcaagatggtcgagccctggctgcgcggcaaccagttctgcatcaagatcctgaacccgtacatgcccagcgtggtggagaccctcgagcagatgcagcggaagcacggcgggatgctggtccgcaaccccctgtcccggaacagcacccacgagatgtactgggtgtcctgcggcaccgggaacatcgtgagcgccgtcaacatgacgtcccgcatgctcctgaaccgcttcaccatggcccaccggaagcccacctacgagcgcgacgtggacctgggcgcgggcacccggcacgtgacggtcgagccggaggtggccaacctcgacatcatcgggcagcgcatcgagaacatcaagaacgagcacaagagcacctggcactacgacgaggacaacccctacaagacctgggcctaccacggctcctacgaggtgaagcccagcgggtccgccagctccatggtcaacggcgtggtccggctgctgaccaagccctgggacgtgatcccgatggtgacgcagatcgccatgaccgacaccacccccttcgggcagcagcgcgtcttcaaggagaaggtggacacgcggacgccccgggcgaagcggggcaccacccagatcatggaggtgacggccaagtggctctggggcttcctgagccgcaacaagaagccgcggatctgcacccgcgaggagttcacccggaaggtccgctccaacgccgccatcggggccgtgttcgtggacgagaaccagtggaacagcgcgaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggcgatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgccgacgacacggccgggtgggacacccgcatcaccgaggacgacctccagaacgaggcgaagatcaccgacatcatggagcccgagcacgccctgctggccacgtccatcttcaagctcacctaccagaacaaggtggtgcgggtccagcgccccgccaagaacggcaccgtgatggacgtgatcagccggcgcgaccagcgggggtccggccaggtcggcacctacgggctgaacacgttcaccaacatggaggtgcagctgatccgccagatggagagcgagggcatcttcctcccgtccgagctggagacccccaacctggccgagcgggtgctcgactggctggagaagcacggggcggagcgcctgaagcggatggccatcagcggcgacgactgcgtcgtgaagcccatcgacgaccgcttcgccaccgccctcaccgccctgaacgacatggggaaggtgcggaaggacatcccccagtgggagccgtccaagggctggaacgactggcagcaggtccccttctgcagccaccacttccaccagctgatcatgaaggacggccgcgagatcgtggtgccctgccggaaccaggacgagctcgtcgggcgcgcgcgggtgtcccagggcgccgggtggagcctgcgcgagacggcctgcctgggcaagtcctacgcccagatgtggcagctcatgtacttccaccggcgcgacctgcggctggccgcgaacgccatctgcagcgccgtgcccgtcgactgggtgccgacctcccgcaccacctggagcatccacgcccaccaccagtggatgacgaccgaggacatgctcagcgtgtggaaccgcgtctggatcgaggagaacccctggatggaggacaagacccacgtgtccagctgggaggaggtgccctacctggggaagcgggaggaccagtggtgcggctccctgatcggcctcaccgcgcgcgccacgtgggccaccaacatccaggtcgccatcaaccaggtgcggcgcctgatcgggaacgagaactacctggactacatgaccagcatgaagcggttcaagaacgagtccgaccccgagggcgccctctggtga

SEQ ID NO: 8175 - RNA, 9879 nt, synthetic construct
  misc_feature 1..9879: note = derived and/or modified CDS sequence (opt1) from DENV-1__KF973475__SS-prME
  source 1..9879: mol_type = other RNA
agcgtgaccatgctgctcatgctgatgcccaccgccctggccttccacctcacgacccgcggcggggagccgcacatgatcgtctccaagcacgagcggggcaaggcgctgctgttcaagaccagcaccggggtgaacatgtgcacgctcatcgccatggacctgggcgagctgtgcgaggacaccatgacctacaagtgcccccgcatcaccgaggccgagcccgacgacgtggactgctggtgcaacgccacggacacctgggtcacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccacccggggttcaccgtgatcgccctgttcctggcgcacgccatcggcacctccatcacccagaaggggatcatcttcatcctcctgatgctggtgacgcccagcatggccatgcggtgcgtcggcatcggcaaccgcgacttcgtggaggggctctccggcgccacctgggtggacgtcgtgctggagcacgggagctgcgtgaccaccatggccaagaacaagcccacgctggacatcgagctcctgaagaccgaggtcaccaaccccgcggtgctgcggaagctctgcatcgaggccaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcctgacctgcgccaagttcaagtgcgtgaccaagctggagggcaagatcgtccagtacgagaacctcaagtacagcgtgatcgtgaccgtccacacgggcgaccagcaccaggtggggaacgagaccaccgagcacggcaccatcgcgaccatcacgccccaggcccccacctccgagatccagctgaccgactacggggccctgaccctcgactgcagcccccgcacgggcctggacttcaacgagatggtcctgctcaccatgaaggagaagtcctggctggtgcacaagcagtggttcctggacctcccgctgccctggaccagcggggcctccaccagccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcaccagctacgtcatgtgcacggggtccttcaagctggagaaggaggtggcggagacccagcacggcaccgtgctggtccaggtgaagtacgagggcaccgacgccccctgcaagatccccttcagcacgcaggacgagaagggggtgacccagaacggccggctgatcaccgccaacccgatcgtcaccgacaaggagaagcccgtgaacatcgagacggagccccccttcggggagtcctacatcgtggtcggcgccggcgagaaggcgctcaagctgagctggttcaagaaggggtccagcatcggcaagatgttcgaggccaccgcccgcggggcccggcgcatggccatcctgggcgacaccgcgtgggacttcgggtccatcggcggcgtgttcaccagcgtggggaagctcgtccaccaggtgttcggcacggcctacggggtgctgttctccggcgtcagctggaccatgaagatcgggatcggcatcctgctcacctggctgggcctgaactcccgcagcacctccctcagcatgacgtgcatcgccgtggggatggtgaccctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgactccccgaagcgcctgagcgcggccatcggcaaggcctgggaggagggggtgtgcggcatccggagcgccacgcgcctggagaacatcatgtggaagcagatctccaacgagctcaaccacatcctgctggagaacgggatgaagttcaccgtcgtggtgggcgacgccaacgggatcctcgcgcagggcaagaagatgatccggccccagcccatggagcacaagtacagctggaagtcctggggcaaggccaagatcatcggggccgacatccagaacaccaccttcatcatcgacggccccgacacgccggagtgccccgacgaccagcgcgcctggaacatctgggaggtcgaggactacgggttcggcatcttcaccaccaacatctggctgaagctgcgggacagctacacccagatgtgcgaccaccgcctcatgtccgcggccatcaaggacagcaaggccgtgcacgccgacatgggctactggatcgagtccgagaagaacgagacgtggaagctggcccgggcgagcttcatcgaggtgaagacctgcacctggcccaagtcccacaccctgtggagcaacggggtcctcgagtccgagatgatcatccccaagatctacggcgggccgatcagccagcacaactaccgccccggctacttcacgcagaccgccgggccctggcacctgggcaagctggagctcgacttcgacctgtgcgagggcaccaccgtggtggtcgacgagcactgcgggaaccggggcccgtccctgcgcacgaccaccgtgaccgggaagatcatccacgagtggtgctgccggagctgcacgctcccccccctgcgcttccggggcgaggacgggtgctggtacggcatggagatccgccccgtgaaggagaaggaggagaacctggtccggtccatggtgagcgccggctccggggaggtggacagcttcagcctcggcatcctgtgcgtctccatcatgatcgaggaggtgatgcgcagccggtggtcccgcaagatgctgatgaccgggaccctcgccgtgttcctgctgctcatcatgggccagctgacctggaacgacctgatccgcctctgcatcatggtcggggccaacgcgagcgaccggatgggcatgggcacgacctacctggccctgatggccaccttcaagatgcgcccgatgttcgccgtggggatcctcttccggcgcctgacctcccgggaggtgctgctcctgacgatcggcctgagcctcgtcgcctccgtggagctgcccaacagcctggaggagctcggggacggcctggcgatgggcatcatgatgctgaagctcctgaccgagttccagccccaccagctgtggaccaccctcctgtccctgacgttcatcaagaccaccctcagcctggactacgcctggaagaccacggccatggccctgtccatcgtcagcctcttccccctgtgcctgtccaccaccagccagaagaccacctggctcccggtgctgctggggtccttcggctgcaagcccctcacgatgttcctgatcaccgagaacaagatctgggggcgcaagagctggcccatcaacgagggcatcatggcgatcgggatcgtgtccatcctgctcagctccctgctgaagaacgacgtccccctcgccggcccgctgatcgccggcgggatgctgatcgcctgctacgtgatcagcggcagctccgccgacctcagcctggagaaggcggccgaggtgtcctgggagcaggaggccgagcacagcgggacctcccacaacatcctggtcgaggtgcaggacgacggcaccatgcggatcaaggacgaggagaaggacgacacgctcaccatcctgctgaaggccaccctcctggccgtgagcggggtctaccccatgtccatccccgcgaccctgttcgtgtggtacttctggcagaagaagaagcagcgcagcggcgtgctctgggacacgccctccccgcccgaggtcgagcgggccgtgctggacgacggcatctaccgcatcctgcagcgggggctcctgggccgcagccaggtgggggtcggcgtgttccaggacggggtgttccacaccatgtggcacgtcacccggggcgccgtgctgatgtaccagggcaagcgcctggagccctcctgggccagcgtgaagaaggacctcatctcctacgggggcgggtggcggttccagggcagctggaacaccggggaggaggtccaggtgatcgccgtggagcccggcaagaacccgaagaacgtccagacgacccccggcaccttcaagacctccgagggggaggtgggcgcgatcgccctggacttcaagcccgggacgagcggctcccccatcgtgaaccgcgagggcaagatcgtcgggctgtacggcaacggggtggtgaccaccagcggcacctacgtctccgccatcgcccaggccaagacgagccaggaggggccgctccccgagatcgaggacgaggtgttcaagaagcggaacctgaccatcatggacctgcaccccggcagcggcaagacccgccggtacctcccggcgatcgtgcgcgaggccatcaagcggaagctgcgcaccctgatcctcgcccccacgcgcgtcgtggcctccgagatggcggaggccctgaaggggatgcccatccggtaccagaccaccgccgtgaagagcgagcacaccggccgcgagatcgtcgacctgatgtgccacgccacgttcaccatgcggctcctgtcccccgtgcgcgtgccgaactacaacatgatcatcatggacgaggcccacttcaccgaccccgcgagcatcgccgcccgggggtacatctccacccgcgtcggcatgggggaggccgccgcgatcttcatgacggccaccccccccggcagcgtggaggccttcccgcagtccaacgccgtgatccaggacgaggagcgggacatccccgagcgcagctggaactccggctacgactggatcaccgacttccccgggaagaccgtctggttcgtgcccagcatcaagtccggcaacgacatcgccaactgcctgcggaagaacgggaagcgcgtgatccagctcagccggaagacgttcgacaccgagtaccagaagaccaagaacaacgactgggactacgtcgtgaccacggacatctccgagatgggcgcgaacttccgcgccgaccgggtgatcgacccgcgccggtgcctgaagcccgtcatcctgaaggacgggcccgagcgcgtgatcctcgccggccccatgccggtgaccgtcgccagcgcggcccagcggcgcggccggatcgggcgcaaccagaacaaggagggcgaccagtacgtgtacatggggcagcccctgaacaacgacgaggaccacgcccactggaccgaggccaagatgctgctcgacaacatcaacacccccgagggcatcatccccgccctgttcgagccggagcgcgagaagtccgcggccatcgacggggagtaccggctgcgcggcgaggcccggaagaccttcgtcgagctcatgcgccggggcgacctgcccgtgtggctgagctacaaggtggcctccgaggggttccagtacagcgaccgccggtggtgcttcgacggcgagcgcaacaaccaggtcctcgaggagaacatggacgtggagatctggacgaaggagggggagcggaagaagctgcgcccccggtggctggacgcccgcacctactccgaccccctcgcgctgcgggagttcaaggagttcgccgccggccgccggagcgtgagcggcgacctgatcctcgagatcgggaagctgccgcagcacctgaccctccgcgcccagaacgccctggacaacctggtcatgctccacaactccgagcagggcgggaaggcgtaccggcacgccatggaggagctgcccgacaccatcgagacgctgatgctcctggccctgatcgccgtgctcaccggcggggtgaccctgttcttcctgagcggcaagggcctcgggaagacctccatcggcctgctgtgcgtcacggcgagctccgccctcctgtggatggccagcgtggagccccactggatcgccgcctccatcatcctggagttcttcctcatggtgctgctgatccccgagccggaccgccagcggaccccccaggacaaccagctcgcgtacgtcgtgatcgggctgctgttcatgatcctcaccgtggccgccaacgagatgggcctgctggagaccacgaagcgcgacctcgggatcggccacgtcgccgccgagaaccaccagcacgcgaccatgctggacgtggacctgcggcccgccagcgcctggaccctctacgccgtggccaccacggtcatcaccccgatgatgcgccacaccatcgagaacaccacggcgaacatctccctgaccgccatcgccaaccaggccgccatcctgatgggcctcgacaaggggtggcccatcagcaagatggacatcggcgtgcccctgctggcgctcgggtgctactcccaggtgaaccccctgaccctgaccgccgccgtcctcatgctggtggcccactacgcgatcatcggcccggggctgcaggccaaggccacgcgcgaggcccagaagcggaccgccgcgggcatcatgaagaaccccaccgtggacggcatcgtcgccatcgacctcgaccccgtggtgtacgacgccaagttcgagaagcagctggggcagatcatgctgctcatcctgtgcaccagccagatcctgctcatgcgcacgacctgggccctgtgcgagtccatcaccctggccaccggccccctcacgaccctgtgggaggggagcccgggcaagttctggaacaccaccatcgcggtctccatggccaacatcttccggggcagctacctggccggggccggcctcgccttctccctgatgaagagcctggggggcgggcgccggggcacgggcgcgcagggggagaccctcggcgagaagtggaagcgccagctgaaccagctgtccaagcccgagttcaacacctacaagcggagcgggatcatggaggtggaccgcagcgaggccaaggagggcctcaagcggggggagaccaccaagcacgccgtgtcccgcggcacggccaagctgcggtggttcgtcgagcgcaacctggtgaagcccgagggcaaggtgatcgacctcgggtgcggccgggggggctggagctactactgcgcggggctgaagaaggtcaccgaggtgaagggctacaccaagggcgggcccggccacgaggagccgatccccatggccacctacgggtggaacctggtgaagctgcactccggcaaggacgtcttcttcatgccccccgagaagtgcgacacgctcctgtgcgacatcggggagagctccccgaaccccaccatcgaggagggccgcaccctgcgggtgctcaagatggtggagccctggctgcgcggcaaccagttctgcatcaagatcctgaacccctacatgccgagcgtcgtggagaccctcgagcagatgcagcggaagcacgggggcatgctggtgcgcaaccccctgtcccggaacagcacgcacgagatgtactgggtctcctgcgggaccggcaacatcgtgagcgccgtgaacatgacctcccgcatgctcctgaaccgcttcaccatggcccaccggaagcccacgtacgagcgcgacgtcgacctgggcgccgggacccggcacgtggcggtggagcccgaggtcgccaacctcgacatcatcggccagcgcatcgagaacatcaagaacgagcacaagagcacctggcactacgacgaggacaacccgtacaagacctgggcctaccacgggtcctacgaggtgaagcccagcggctccgccagctccatggtgaacggggtcgtgcggctgctgacgaagccctgggacgtcatccccatggtgacccagatcgccatgaccgacaccacgccgttcggccagcagcgcgtgttcaaggagaaggtcgacacccggaccccccgcgcgaagcggggcaccacgcagatcatggaggtgaccgccaagtggctctgggggttcctgagccgcaacaagaagccccggatctgcacccgcgaggagttcacccggaaggtgcgctccaacgccgccatcggcgccgtcttcgtggacgagaaccagtggaacagcgcgaaggaggccgtggaggacgagcggttctgggacctggtccaccgcgagcgggagctccacaagcaggggaagtgcgccacgtgcgtgtacaacatgatgggcaagcgcgagaagaagctgggggagttcggcaaggccaagggcagccgggcgatctggtacatgtggctgggggcccgcttcctcgagttcgaggccctgggcttcatgaacgaggaccactggttctcccgggagaacagcctgtccggggtggagggcgaggggctccacaagctgggctacatcctgcgcgacatcagcaagatcccgggcgggaacatgtacgccgacgacaccgccggctgggacacccgcatcaccgaggacgacctccagaacgaggcgaagatcacggacatcatggagcccgagcacgccctgctggccacctccatcttcaagctcacctaccagaacaaggtcgtgcgggtgcagcgccccgccaagaacgggaccgtcatggacgtgatcagccggcgcgaccagcggggctccggccaggtggggacgtacggcctgaacaccttcaccaacatggaggtccagctgatccgccagatggagagcgaggggatcttcctcccctccgagctggagaccccgaacctggccgagcgggtgctcgactggctggagaagcacggcgcggagcgcctgaagcggatggccatcagcggggacgactgcgtggtcaagcccatcgacgaccgcttcgccaccgccctcacggccctgaacgacatgggcaaggtgcggaaggacatcccccagtgggagccctccaagggctggaacgactggcagcaggtgccgttctgcagccaccacttccaccagctgatcatgaaggacgggcgcgagatcgtcgtgccctgccggaaccaggacgagctcgtgggccgcgcgcgggtctcccagggggccggctggagcctgcgcgagaccgcctgcctggggaagtcctacgcccagatgtggcagctcatgtacttccaccggcgcgacctgcggctggccgcgaacgccatctgcagcgccgtgcccgtggactgggtccccacctcccgcaccacgtggagcatccacgcccaccaccagtggatgaccaccgaggacatgctcagcgtgtggaaccgcgtgtggatcgaggagaacccgtggatggaggacaagacccacgtctccagctgggaggaggtgccctacctgggcaagcgggaggaccagtggtgcggctccctgatcgggctcacggcgcgcgccacctgggccaccaacatccaggtggccatcaaccaggtccggcgcctgatcggcaacgagaactacctggactacatgaccagcatgaagcggttcaagaacgagtccgaccccgagggggccctctggtga

SEQ ID NO: 8176 - RNA, 9879 nt, synthetic construct
  misc_feature 1..9879: note = derived and/or modified CDS sequence (opt1) from DENV-1__FJ898448__SS-prME
  source 1..9879: mol_type = other RNA
agcgtgaccatgctgctcatgctgctgcccaccgtgctcaccttccacctgaccacccgcggcggggagccccacatgatcgtgagcaagcaggagcggggcaagagcctcctgttcaagacctccgccggggtgaacatgtgcacgctgatcgccatggacctgggcgagctctgcgacgacaccatgacctacaagtgcccccgcatcaccgagacggagcccgacgacgtggactgctggtgcaacgccaccgagacctgggtgacctacgggacgtgcagccagaccggcgagcaccggcgcgacaagcggtccgtggccctggcgccccacgtcggcctggggctcgagacccgcaccgagacgtggatgagctccgagggcgcctggcggcagatccagaaggtggagacctgggccctgcgccaccccgggttcaccgtgatcgccctgttcctcgcccacgccatcggcaccagcatcacgcagaaggggatcatcttcatcctgctgatgctcgtgaccccctccatggccatgcggtgcgtgggcatcggcaaccgcgacttcgtggaggggctgagcggcgcgacctgggtcgacgtggtgctggagcacgggtcctgcgtcaccacgatggccaaggacaagcccaccctcgacatcgagctgctgaagaccgaggtgaccaaccccgccgtgctccggaagctgtgcatcgaggccaagatcagcaacacgaccaccgactcccgctgcccgacccagggcgaggccacgctggtcgaggagcaggacaccaacttcgtgtgccggcgcaccttcgtggaccggggctgggggaacggctgcggcctcttcggcaaggggagcctgatcacgtgcgcgaagttcaagtgcgtcacgaagctggagggcaagatcgtgcagtacgagaacctcaagtactccgtgatcgtcaccgtgcacaccggcgaccagcaccaggtcgggaacgagaccaccgagcacggcacgatcgccaccatcacgccccaggcccccaccagcgagatccagctgacggactacggggccctgaccctcgactgcagcccccggaccggcctggacttcaacgagatggtgctgctcaccatgaaggagaagtcctggctggtgcacaagcagtggttcctggacctcccgctgccctggacgtccggggccagcaccagccaggagacctggaaccggcaggacctgctcgtcaccttcaagacggcgcacgccaagaagcaggaggtggtggtcctgggctcccaggagggcgccatgcacaccgccctgaccggggccaccgagatccagacgagcggcaccaccaccatcttcgcggggcacctcaagtgccgcctgaagatggacaagctgacgctcaagggcatctcctacgtgatgtgcaccgggagcttcaagctggagaaggaggtggccgagacccagcacggcaccgtcctggtccaggtgaagtacgagggcacggacgccccctgcaagatccccttctccagccaggacgagaagggggtcacccagaacggccggctggtgaccgccaacccgatcgtgaccgacaaggagaagcccgtcaacatcgaggccgagccgcccttcggggagtcctacatcgtggtgggcgcgggcgagaaggccctcaagctgagctggttcaagaaggggtccagcatcggcaagatgttcgaggccacggcccgcggggcgcggcgcatggccatcctgggcgacaccgcctgggacttcgggtccatcggcggcgtcttcaccagcgtggggaagctcgtgcaccagatcttcggcaccgcctacggggtcctgttctccggcgtgagctggacgatgaagatcgggatcggcatcctgctcacctggctgggcctgaactcccgcagcacctccctcagcatgacctgcatcgccgtggggatggtcacgctgtacctgggcgtgatggtgcaggcggactccgggtgcgtcatcaactggaagggccgggagctcaagtgcgggagcggcatcttcgtgaccaacgaggtgcacacctggaccgagcagtacaagttccaggccgacagcccgaagcgcctgtccgccgccatcggcaaggcctgggaggagggggtctgcggcatccggagcgcgacccgcctggagaacatcatgtggaagcagatctccaacgagctcaaccacatcctgctggagaacgacatgaagttcacggtggtggtcggggacgtgagcggcatcctcgcccaggggaagaagaccatccggccccagcccatggagcacaagtactcctggaagtcctggggcaaggccaagatcatcggcgccgacgtgcagaacaccaccttcatcatcgacgggcccaacacgccggagtgccccgacgaccagcgcgcctggaacatctgggaggtcgaggactacggcttcgggatcttcaccaccaacatctggctgaagctgcgggactcctacacccaggtgtgcgaccaccgcctcatgagcgcggccatcaaggactccaaggccgtgcacgccgacatgggctactggatcgagagcgagaagaacgagacgtggaagctggcgcgggcctccttcatcgaggtcaagacctgcgtgtggcccaagagccacaccctgtggtccaacggcgtgctcgagagcgagatgatcatccccaagatctacgggggcccgatctcccagcacaactaccgccccgggtacttcacccagacggccggcccctggcacctggggaagctggagctcgacttcgacctgtgcgagggcaccaccgtcgtggtggacgagcactgcggcaaccgggggccgagcctgcgcaccacgaccgtcaccggcaagatcatccacgagtggtgctgccggtcctgcaccctgccgcccctgcgcttcaagggggaggacggctgctggtacgggatggagatccggcccgtgaaggagaaggaggagaacctggtcaagagcatggtcagcgccggctccggcgaggtggacagcttctccctcgggctgctgtgcatcagcatcatgatcgaggaggtgatgcgctcccggtggagccgcaagatgctcatgacgggcaccctggtcgtgttcctgctcctgaccctggggcagctcacctggaacgacctgatccggctgtgcatcatggtcggcgccaacgcgtccgacaacatggggatgggcacgacctacctcgccctgatggccaccttccgcatgcgcccgatgttcgccgtgggcctcctcttccggcgcctgaccagccgggaggtgctgctcctgacggtcgggctgtccctcgtggccagcgtggagctgcccaactccctggacgagctcggcgacgggctggcgatgggcatcatgatcctgaagctcctgaccgacttccagagccaccagctgtgggccaccctcctgtccctgaccttcgtcaagacgaccctcagcctgcactacgcctggaagaccatggccatgatcctgtccatcgtgagcctcctgcccctgtgcctctccaccacgagccagaagaccacctggctgcccgtgctgctcggctccctggggtgcaagccgctgaccatgttcctcatcaccgagaacaagatctggggccgcaagagctggcccctgaacgaggggatcatggccgtcggcatcgtgagcatcctgctctccagcctgctgaagaacgacgtgcccctcgcggggcccctgatcgccggcggcatgctgatcgcctgctacgtcatctccgggagctccgccgacctcagcctggagaaggcggccaaggtgtcctgggaggaggaggccgagcacagcggcgcctcccacaacatcctggtggagatccaggacgacgggacgatgaagatcaaggacgaggagcgggacgacaccatcaccatcctcctgaaggccaccctgctcgcgatcagcggcgtctacccgatgtccatccccgccacgctgttcgtgtggcacttctggcagaagaagaagcagcgcagcggggtgctgtgggacacccccagcccgcccgaggtcgagaaggccgtgctggacgacggcatctaccggatcctccagcgcggcctgctggggcggagccaggtgggcgtcggggtgttccaggagggcgtgttccacaccatgtggcacgtcacccgcggggccgtgctcatgtaccagggcaagcggctggagccctcctgggccagcgtgaagaaggacctgatctcctacggcgggggctggcgcttccaggggagctggaacacgggcgaggaggtccaggtgatcgcggtggagcccgggaagaaccccaagaacgtccagaccgcccccggcaccttcaagacctccgagggcgaggtgggggccatcgccctcgacttcaagcccggcacgagcgggagccccatcgtgaaccgggagggcaagatcgtcggcctgtacgggaacggcgtggtgaccacctccgggacctacgtcagcgccatcgcgcaggccaaggcctcccaggagggccccctgccggagatcgaggacgaggtgttccgcaagcggaacctcacgatcatggacctgcaccccgggagcggcaagacccgccggtacctgcccgccatcgtgcgcgaggccatcaagcggaagctccgcaccctggtcctggcgccgacccgggtggtggcctccgagatggccgaggccctcaagggcatgcccatccgctaccagacgaccgcggtcaagagcgagcacaccgggaaggagatcgtggacctgatgtgccacgccaccttcacgatgcgcctgctctcccccgtgcgggtccccaactacaacatgatcatcatggacgaggcccacttcaccgacccggccagcatcgccgcgcgcggctacatctccacccgggtggggatgggcgaggccgccgccatcttcatgaccgccacgccgcccgggagcgtggaggcgttcccccagtccaacgccgtcatccaggacgaggagaaggacatcccggagcgcagctggaactccggctacgactggatcaccgacttccccggcaagaccgtgtggttcgtgcccagcatcaagtccgggaacgacatcgccaactgcctgcggaagaacggcaagcgcgtcatccagctgagccggaagaccttcgacacggagtaccagaagaccaagaacaacgactgggactacgtggtcaccaccgacatctccgagatgggggccaacttccgcgccgaccgggtgatcgacccccgccggtgcctcaagccggtgatcctgaaggacggccccgagcgcgtcatcctggcggggcccatgcccgtgacggtggccagcgccgcccagcggcgcggccggatcggccgcaaccagaacaaggagggggaccagtacatctacatgggccagccgctcaacaacgacgaggaccacgcgcactggaccgaggccaagatgctgctggacaacatcaacacccccgaggggatcatccccgccctcttcgagcccgagcgggagaagtccgccgccatcgacggcgagtaccgcctgcgcggggaggcgcgcaagaccttcgtcgagctgatgcgccggggcgacctcccggtgtggctgagctacaaggtggccagcgagggcttccagtactccgaccgccggtggtgcttcgacggggagcgcaacaaccaggtcctggaggagaacatggacgtggagatctggacgaaggagggcgagcggaagaagctccgcccccggtggctggacgcccgcacctacagcgaccccctggccctccgggagttcaaggagttcgccgcggggcgccggtccgtgagcggcgacctgatcctggagatcggcaagctcccccagcacctgacccagcgcgcccagaacgccctggacaacctcgtcatgctgcacaactccgagcagggcgggaaggcctaccggcacgccatggaggagctgccggacaccatcgagaccatcatgctcctggcgctgatcgccgtgctcaccggcggggtgaccctgttcttcctgagcgggcgcgggctcggcaagacctccatcgggctgctgtgcgtcaccagctccagcgccctcctgtggatggcctccgtggagccccactggatcgcggccagcatcatcctggagttcttcctcatggtgctgctgatccccgagcccgaccggcagcgcacgccgcaggacaaccagctcgcctacgtcgtgatcggcctgctgttcatgatcctcaccgtggccgccaacgagatggggctgctggagaccaccaagaaggacctcggcatcgggcacgcggccgccgagaaccaccaccacgccgccatgctggacgtcgacctgcaccccgcgtccgcctggacgctctacgccgtggccaccaccatcatcacccccatgatgcggcacacgatcgagaacaccaccgccaacatcagcctgaccgcgatcgccaaccaggccgccatcctgatgggcctcgacaagggctggccgatctccaagatggacatcggggtgcccctgctggccctcggctgctacagccaggtcaaccccctgacgctgaccgcggccgtgctcatgctggtggcccactacgccatcatcgggcccggcctgcaggcgaaggccacccgcgaggcccagaagcggaccgccgccgggatcatgaagaacccgacggtcgacggcatcgtggcgatcgacctcgaccccgtggtctacgacgccaagttcgagaagcagctgggccagatcatgctgctcatcctgtgcacctcccagatcctgctcatgcgcaccacctgggccctgtgcgagagcatcacgctggccaccgggcccctcaccaccctgtgggagggctcccccgggaagttctggaacacgaccatcgccgtgagcatggcgaacatcttccggggcagctacctggccggcgccgggctcgccttctccctgatgaagtccctgggcgggggccgccgcgggaccggcgcccagggcgagaccctcggggagaagtggaagcggcagctgaaccagctgtccaagagcgagttcaacacgtacaagcgctccggcatcatcgaggtggaccggagcgaggcgaaggaggggctcaagcgcggcgagaccaccaagcacgccgtctcccgggggaccgccaagctgcgctggttcgtggagcggaacctggtgaagccggagggcaaggtcatcgacctgggctgcgggcgcggcgggtggagctactactgcgccggcctcaagaaggtgacggaggtgaaggggtacaccaagggcggccccgggcacgaggagcccatccccatggcgacctacggctggaacctggtcaagctgcactccgggaaggacgtgttcttcatcccgcccgagaagtgcgacaccctcctgtgcgacatcggcgagagctcccccaaccccaccatcgaggaggggcggacgctgcgcgtgctcaagatggtcgagccgtggctgcggggcaaccagttctgcatcaagatcctgaacccctacatgcccagcgtggtggagaccctcgagcagatgcagcgcaagcacggcgggatgctggtccggaaccccctgtcccgcaacagcacccacgagatgtactgggtgtcctgcggcaccgggaacatcgtgagcgccgtcaacatgacgtcccggatgctcctgaaccgcttcaccatggcccaccggaagccgacctacgagcgcgacgtggacctgggcgccggcacccggcacgtggccgtcgagcccgaggtggcgaacctcgacatcatcgggcagcgcatcgagaacatcaagaacgagcacaagagcacgtggcactacgacgaggacaacccctacaagacctgggcctaccacggctcctacgaggtcaagcccagcgggagcgcctccagcatggtgaacggcgtggtccgcctgctgaccaagccgtgggacgtgatccccatggtgacccagatcgccatgacggacaccacccccttcgggcagcagcgggtcttcaaggagaaggtggacacccgcacgcccaaggccaagcggggcaccgcgcagatcatggaggtgaccgccaagtggctctggggcttcctgtcccgcaacaagaagccgcggatctgcacccgcgaggagttcacgcggaaggtccgcagcaacgccgccatcggggccgtgttcgtggacgagaaccagtggaactccgcgaaggaggccgtcgaggacgagcggttctgggacctggtgcgccgggagcgcgagctccacaagcagggcaagtgcgcgacctgcgtgtacaacatgatggggaagcgggagaagaagctgggcgagttcgggaaggccaagggcagccgcgcgatctggtacatgtggctgggcgcccggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgccgacgacaccgccgggtgggacacccgcatcacggaggacgacctccagaacgaggcgaagatcaccgacatcatggagcccgagcacgccctgctggccacctccatcttcaagctcacctaccagaacaaggtggtgcgggtccagcgcccggccaagaacggcacggtgatggacgtgatcagccggcgcgaccagcgcgggtccggccaggtcggcacctacgggctgaacaccttcaccaacatggaggcccagctgatccggcagatggagagcgagggcatcttctcccccagcgagctcgagacgcccaacctggcggggcgcgtgctggactggctcgagaagcacggcaccgagcggctgcgccggatggccatctccggggacgactgcgtggtcaagcccatcgacgaccgcttcgccaccgccctgaccgccctcaacgacatgggcaaggtgcggaaggacatcccgcagtgggagcccagcaagggctggaacgactggcagcaggtccccttctgcagccaccacttccaccagctgatcatgaaggacgggcgcgagatcgtcgtgccctgccggaaccaggacgagctggtgggccgcgcgcgggtctcccagggggccggctggagcctccgcgagacggcctgcctggggaagtcctacgcccagatgtggcagctgatgtacttccaccggcgcgacctccggctggccgcgaacgccatctgcagcgccgtgccggtggactgggtccccacctcccgcaccacctggagcatccacgcccaccaccagtggatgaccacggaggacatgctgtccgtgtggaaccgggtgtggatcgaggagaacccctggatggaggacaagacccacgtcagctcctgggaggacgtgccctacctcggcaagcgcgaggaccagtggtgcggcagcctgatcgggctgaccgcgcgggccacctgggccacgaacatccaggtggccatcaaccaggtccgccgcctcatcggcaacgagaactacctggactacatgacctccatgaagcggttcaagaacgagagcgacccggagggggccctgtggtga

SEQ ID NO: 8177 - RNA, 9879 nt, synthetic construct
  misc_feature 1..9879: note = derived and/or modified CDS sequence (opt1) from DENV-1__GQ868602__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagacctccgccggggtgaacatgtgcaccctgatcgccatggacctgggcgagctctgcgaggacaccatgacctacaagtgcccccggatcaccgagaccgagcccgacgacgtggactgctggtgcaacgccaccgagacctgggtgacctacgggacctgcagccagaccggcgagcaccggcgcgacaagcggtccgtggccctggcgccccacgtgggcctggggctcgagacccgcaccgagacctggatgagctccgagggcgcgtggcggcagatccagaaggtggagacgtgggccctgcgccaccccgggttcaccgtgatcgccctgttcctcgcccacgcgatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaaggacaagcccacgctcgacatcgagctgctgaagaccgaggtcaccaaccccgccgtgctccggaagctgtgcatcgaggcgaagatcagcaacaccacgaccgactcccgctgccccacccagggcgaggccaccctggtggaggagcaggacacgaacttcgtctgccggcgcaccttcgtggaccggggctgggggaacggctgcggcctgttcggcaaggggagcctgatcacgtgcgccaagttcaagtgcgtgaccaagctggagggcaagatcgtccagtacgagaacctcaagtactccgtgatcgtgacggtccacaccggcgaccagcaccaggtggggaacgagaccaccgagcacggcaccacggccaccatcacgccccaggcccccaccagcgagatccagctgacggactacggggcgctgaccctcgactgcagcccccggaccggcctggacttcaacgagatggtcctgctcaccatgaaggagaagtcctggctggtgcacaagcagtggttcctggacctcccgctgccctggacgtccggggccagcaccagccaggagacctggaaccggcaggacctgctcgtgaccttcaagacggcccacgccaagaagcaggaggtcgtggtgctgggctcccaggagggcgccatgcacaccgcgctgaccggggccaccgagatccagacgagcggcaccaccaccatcttcgccgggcacctcaagtgccgcctgaagatggacaagctgacgctcaagggcgtctcctacgtgatgtgcaccgggagcttcaagctggagaaggaggtggccgagacccagcacggcaccgtcctggtccaggtgaagtacgagggcacggacgccccctgcaagatccccttctccagccaggacgagaagggggtcacccagaacggccggctgatcaccgcgaacccgatcgtgaccgacaaggagaagcccgtgaacatcgaggccgagccgcccttcggggagtcctacctcgtcgtgggcgccggcgagaaggccctgaagctgagctggttcaagaaggggtccagcatcggcaagatgttcgaggcgacggcccgcggggcccggcgcatggccatcctcggcgacaccgcctgggacttcgggtccatcggcggcgtgttcaccagcgtcgggaagctgatccaccagatcttcggcaccgcgtacggggtgctgttctccggcgtgagctggacgatgaagatcgggatcggcatcctcctgacctggctgggcctcaactcccgcagcacctccctgagcatgacctgcatcgccgtcgggatggtgacgctgtacctcggcgtgatggtccaggccgactccgggtgcgtgatcaactggaagggccgggagctgaagtgcgggagcggcatcttcgtgaccaacgaggtccacacctggaccgagcagtacaagttccaggccgacagcccgaagcgcctgtccgccgcgatcggcaaggcctgggaggagggggtgtgcggcatccggagcgccacccgcctcgagaacatcatgtggaagcagatctccaacgagctgaaccacatcctgctcgagaacgacatgaagttcacggtggtcgtgggggacgtgaacggcgtcctggcccaggggaagaagatgatccggccccagcccatggagcacaagtacagctggaagtcctggggcaaggccaaggtgatcggcgcggacgtgcagaacatcaccttcatcatcgacgggcccaacaccccggagtgccccgacgaccagcgcgcctggaacatctgggaggtcgaggactacggcttcgggatcttcaccacgaacatctggctgaagctccgggacagctacacccaggtgtgcgaccaccgcctgatgtccgccgccatcaaggacagcaaggcggtgcacgccgacatgggctactggatcgagtccgagaagaacgagacctggaagctgacccgggccagcttcatcgaggtcaagacgtgcatctggcccaagtcccacaccctctggagcaacggcgtgctggagtccgagatgatcatccccaagatctacgggggcccgatcagccagcacaactaccgccccgggtacttcacccagaccgccggcccctggcacctggggaagctcgagctggacttcggcctgtgcgagggcacgaccgtggtcgtggacgagcactgcgggaaccggggcccgtccctccgcaccaccacggtgaccgggaagatcatccacgagtggtgctgccggagctgcaccctgccgcccctgcgcttcaagggcgaggacgggtgctggtacggcatggagatccggcccgtcaaggagaaggaggagaacctcgtgaagtccatggtgagcgccggcagcggggaggtcgactccttcagcctgggcctgctctgcatctccatcatgatcgaggaggtgatgcgcagccggtggtcccgcaagatgctgatgaccgggacgctggcggtgttcctcctgctgatcatgggccagctcacctggaacgacctgatccggctgtgcatcatggtcggggccaacgccagcgacaagatgggcatgggcaccacctacctcgccctgatggccacgttccgcatgcgcccgatgttcgccgtggggctcctgttccggcgcctgacctcccgggaggtcctgctcctgaccgtggggctgagcctcgtggcctccgtcgagctgcccaacagcctggaggagctcggggacggcctggccatgggcatcatgatgctgaagctcctgaccgacttccagtcccaccagctgtgggccacgctcctgagcctgaccttcgtgaagaccaccttctccctccactacgcctggaagacgatggcgatgatcctgagcatcgtgtccctgttccccctctgcctgagcaccacctcccagaagaccacgtggctgcccgtcctcctggggagcctgggctgcaagccgctcaccatgttcctgatcaccgagaacaagatctgggggcgcaagtcctggcccctgaacgagggcatcatggccgtggggatcgtgagcatcctcctgagctccctgctcaagaacgacgtccccctggccggccccctgatcgccggcgggatgctcatcgcgtgctacgtgatcagcggctccagcgccgacctgtccctggagaaggccgccgaggtgagctgggaggaggaggccgagcactccggggcgagccacaacatcctcgtcgaggtgcaggacgacggcaccatgaagatcaaggacgaggagcgggacgacaccctgacgatcctgctcaaggccaccctgctggccatctccggggtgtacccgatgagcatccccgccaccctcttcgtctggtacttctggcagaagaagaagcagcgctccggcgtgctgtgggacacccccagcccgcccgaggtggagcgggccgtcctggacgacggcatctaccgcatcctgcagcgggggctcctgggcaagtcccaggtgggggtgggcgtcttccaggagggggtgttccacacgatgtggcacgtgacccgcggcgcggtcctgatgtaccagggcaagcggctcgagcccagctgggcctccgtgaagaaggacctgatcagctacgggggcgggtggcgcttccagggctcctggaacatgggggaggaggtgcaggtcatcgccgtggagcccggcaagaaccccaagaacgtgcagaccgcccccggcaccttcaagacgcccgagggggaggtcggcgccatcgcgctggacttcaagcccgggaccagcggctcccccatcgtgaaccgggagggcaagatcgtggggctctacggcaacggggtcgtgaccaccagcggcacgtacgtgagcgccatcgcccaggccaaggcctcccaggaggggccgctgcccgagatcgaggacgaggtcttccgcaagcggaacctgaccatcatggacctccaccccggcagcggcaagacccgccggtacctgccggcgatcgtgcgcgaggccatcaagcggaagctgcgcaccctcgtgctggcccccacgcgggtcgtggcctccgagatggcggaggccctgaaggggatgcccatccgctaccagaccaccgccgtcaagagcgagcacaccggcaaggagatcgtcgacctcatgtgccacgccacgttcaccatgcgcctgctgtcccccgtgcgggtgccgaactacaacatgatcatcatggacgaggcccacttcaccgaccccgcgagcatcgccgcccgcgggtacatctccacccgggtcggcatgggggaggccgccgcgatcttcatgacggccacgccgcccggcagcatggaggccttcccgcagtccaacgccgccatccaggacgaggagcgcgacatccccgagcggagctggaactccggctacgactggatcaccgacttccccgggaagaccgtgtggttcgtgcccagcatcaagtccggcaacgacatcgcgaactgcctccgcaagaacgggaagcgggtcgtgcagctgagccgcaagacgttcgacaccgagtaccagaagaccaagaacaacgactgggactacgtggtcaccacggacatctccgagatgggcgccaacttccgggccgaccgcgtgatcgacccgcggcgctgcctgaagcccgtcatcctcaaggacgggcccgagcgggtgatcctggccggccccatgccggtgaccgtcgcgagcgccgcccagcgccggggccgcatcgggcggaaccagaacaaggagggcgaccagtacatctacatggggcagcccctgaacaacgacgaggaccacgcccactggaccgaggccaagatgctcctggacaacatcaacacccccgagggcatcatccccgcgctgttcgagccggagcgcgagaagtccgccgccatcgacggggagtaccggctccgcggcgaggcccgcaagacgttcgtggagctgatgcggcgcggcgacctgcccgtgtggctcagctacaaggtcgcctccgaggggttccagtacagcgaccggcgctggtgcttcgacggcgagcggaacaaccaggtgctgctgaagaacatggacgtggagatctggaccaaggagggggagcgcaagaagctccggccccgctggctggacgcgcggacctacagcgaccccctggccctccgcgagttcaaggagttcgccgccggccggcgctccgtcagcggcgacctgatcctggagatcgggaagctcccgcagcacctgacccagcgggcccagaacgcgctggacaacctcgtgatgctgcacaactccgagcagggcgggaaggcctaccgccacgccatggaggagctgcccgacacgatcgagaccctcatgctgctggccctcatcgcggtgctgaccggcggggtcaccctgttcttcctcagcggccggggcctggggaagacctccatcggcctgctctgcgtgatggccagctccgccctgctgtggatggccagcgtggagccccactggatcgccgcgtccatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagaccaccaagaaggacctggggatcggccacgtggccgcggagagccaccaccacgccgccatgctggacgtggacctccaccccgcctccgcctggacgctgtacgcggtcgccaccaccatcatcaccccgatgatgcgccacacgatcgagaacaccaccgccaacatcagcctgaccgccatcgccaaccaggcggccatcctcatgggcctggacaaggggtggcccatctccaagatggacatcggcgtgcccctgctcgccctggggtgctacagccaggtgaaccccctgacgctcaccgccgcggtcctgatgctggtggcccactacgccatcatcggcccggggctccaggccaaggccacccgggaggcgcagaagcgcaccgccgccggcatcatgaagaaccccacggtggacggcatcgtcgccatcgacctggaccccgtggtgtacgacgccaagttcgagaagcagctggggcagatcatgctcctgatcctgtgcacctcccagatcctcctgatgcggaccacctgggcgctgtgcgagagcatcacgctcgccaccggccccctgaccaccctgtgggaggggtccccgggcaagttctggaacacgaccatcgccgtcagcatggccaacatcttccgcggctcctacctcgccggggcgggcctggccttcagcctgatgaagtccctcgggggcgggcgccggggcaccggcgcccagggggagaccctgggcgagaagtggaagcgccagctgaaccagctctccaagagcgagttcaacacgtacaagcggtccgggatcatcgaggtggaccgcagcgaggccaaggagggcctgaagcgcggggagaccaccaagcacgcggtgtcccgcggcaccgccaagctgcggtggttcgtcgagcgcaacctggtgaagcccgagggcaaggtgatcgacctcgggtgcggccgcggcgggtggagctactactgcgccgggctgaagaaggtcacggaggtgaaggggtacaccaagggcgggcccggccacgaggagcccatcccgatggccacctacgggtggaacctggtgaagctctactccggcaaggacgtcttcttcacgccgcccgagaagtgcgacacgctgctgtgcgacatcggggagagctcccccaacccgaccatcgaggagggccgcaccctccgggtgctgaagatggtggagccctggctgcgcggcaaccagttctgcatcaaggtcctcaacccctacatgcccagcgtggtggagaccctggagcagatgcagcggaagcacgggggcatgctggtccgcaacccgctctcccggaacagcacccacgagatgtactgggtgtcctgcgggacgggcaacatcgtgagcgccgtcaacatgacctcccgcatgctgctgaaccggttcaccatggcgcaccgcaagcccacctacgagcgggacgtggacctcggcgccgggacgcgcaacgtggccgtcgagcccgaggtggccaacctggacatcatcggccagcgcatcgagaacatcaagaacgagcacaagagcacctggcactacgacgaggacaacccctacaagacctgggcctaccacgggtcctacgaggtcaagccgagcggctccgcgagcagcatggtgaacggggtggtccggctgctcaccaagccctgggacgtgatccccatggtgacgcagatcgccatgaccgacaccacccccttcggccagcagcgcgtcttcaaggagaaggtggacacgcggaccccgaaggccaagcgcggcaccgcccagatcatggaggtgaccgcccggtggctgtgggggttcctgtcccgcaacaagaagccccggatctgcacgcgcgaggagttcacccggaaggtccgcagcaacgcggccatcggcgccgtgttcatcgacgagaaccagtggaactccgccaaggaggcggtggaggacgagcggttctgggacctcgtccaccgcgagcgggagctgcacaagcaggggaagtgcgcgacctgcgtgtacaacatgatgggcaagcgcgagaagaagctgggggagttcggcaaggccaagggcagccgggccatctggtacatgtggctcggggcccgcttcctggagttcgaggcgctgggcttcatgaacgaggaccactggttctcccgggagaacagcctctccggggtggagggcgaggggctgcacaagctgggctacatcctccgcgacatcagcaagatccccggcgggaacatgtacgccgacgacaccgccggctgggacacgcggatcaccgaggacgacctgcagaacgaggccaagatcaccgacatcatggagccggagcacgccctgctcgcgacctccatcttcaagctgacgtaccagaacaaggtcgtgcgcgtgcagcggcccgccaagaacgggaccgtcatggacgtgatcagccgccgcgaccagcggggctccggccaggtggggacctacggcctgaacaccttcacgaacatggaggcccagctcatccgccagatggagagcgaggggatcttcctgccctccgagctggagacccccaacctcgccgagcgggtcctggactggctggagaagcacggcatcgagcgcctcaagcggatggccatcagcggggacgactgcgtggtgaagccgatcgacgaccgcttcgcgaccgccctgaccgccctgaacgacatgggcaaggtccggaaggacatcccccagtgggagccctccaagggctggaacgactggcagcaggtccccttctgcagccaccacttccaccagctcatcatgaaggacgggcgcgagatcgtggtcccgtgccggaaccaggacgagctggtgggccgcgcccgggtgtcccagggggccggctggagcctgcgcgagacggcgtgcctcggcaagagctacgcccagatgtggcagctgatgtacttccaccggcgcgacctgcggctcgccgccaacgcgatctgctccgccgtccccgtggactgggtgcccaccagccgcaccacctggtccatccacgcccaccaccagtggatgacgaccgaggacatgctgagcgtctggaaccgggtgtggatcgaggagaacccctggatggaggacaagacccacgtgtccagctgggaggacgtcccgtacctgggcaagcgcgaggaccagtggtgcggctccctcatcgggctgaccgcccgggccacctgggcgacgaacatccaggtggccatcaaccaggtgcgccgcctgatcggcaacgagaactacctcgactacatgaccagcatgaagcggttcaagaacgagaacgaccccgagggggccctgtggtga

SEQ ID NO: 8178 - RNA, 9879 nt, synthetic construct
  misc_feature 1..9879: note = derived and/or modified CDS sequence (opt1) from DENV-1__KF921911__SS-prME
  source 1..9879: mol_type = other RNA
agcgtgaccatgctgctcatgctgctgcccaccgccctcgccttccacctgaccacccggggcggggagccccacatgatcgtcagcaagcaggagcggggcaagagcctgctgttcaagaccagcgtggggatcaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacgcggaccgagacctggatgagctccgagggcgcctggaagcagatccagaaggtcgagacctgggccctgcggcaccccgggttcacggtgaccgccctgttcctcgcccacgcgatcggcaccagcatcacccagaaggggatcatcttcatcctgctgatgctcgtgacgccctccatggccatgcgctgcgtcggcatcggcaaccgggacttcgtggaggggctgagcggcgccacctgggtggacgtcgtgctggagcacgggtcctgcgtgaccaccatggccaaggacaagcccacgctcgacatcgagctgctgaagaccgaggtcaccaaccccgccgtgctccgcaagctgtgcatcgaggcgaagatcagcaacaccacgaccgactcccggtgcccgacccagggcgaggccaccctggtggaggagcaggacagcaacttcgtctgccgccggacgttcgtggaccgcggctgggggaacggctgcggcctcttcggcaaggggtccctgctgacctgcgccaagttcaagtgcgtgaccaagctcgagggcaagatcgtccagtacgagaacctgaagtacagcgtgatcgtgaccgtccacacgggcgaccagcaccaggtggggaacgagaccaccgagcacggcaccatcgccaccatcacgccccaggcccccacctccgagatccagctgaccgactacggggcgctcaccctggactgcagcccccggacgggcctggacttcaacgagatggtcctcctgaccatgaaggagaagtcctggctggtgcacaagcagtggttcctcgacctgccgctgccctggaccagcggggccagcacctcccaggagacgtggaaccgccaggacctcctggtgaccttcaagaccgcccacgccaagaagcaggaggtcgtggtgctgggcagccaggagggcgccatgcacaccgcgctcacgggggccaccgagatccagacctccggcaccacgaccatcttcgccgggcacctgaagtgccggctgaagatggacaagctcaccctgaagggcatgagctacgtcatgtgcaccgggtccttcaagctggagaaggaggtggccgagacgcagcacggcaccgtgctggtccaggtgaagtacgagggcaccgacgccccctgcaagatccccttcagcgcgcaggacgagaagggggtgacccagaacggccgcctcatcacggccaacccgatcgtcaccgacaaggagaagcccgtgaacatcgagaccgagccgcccttcggggagtcctacatcgtgatcggcgccggcgagaaggccctgaagctgagctggttcaagaaggggtccagcatcggcaagatgttcgaggcgaccgcccgcggggcccgccggatggccatcctcggcgacacggcctgggacttcgggtccatcggcggcgtcttcaccagcgtggggaagctggtgcaccaggtcttcggcgcggcctacggggtgctgttctccggcgtgagctggaccatgaagatcgggatcggcatcctcctgacctggctgggcctcaactcccgcagcacgtccctgagcatgacctgcatcgccgtcgggatggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggccgacagcccgaagcggctgtccgcggccatcggcaaggcctgggaggagggggtgtgcggcatccgcagcgccacccggctcgagaacatcatgtggaagcagatctccaacgagctgaaccacatcctgctcgagaacgacatgaagttcaccgtggtcgtgggggacgccaacggcatcctggcgcaggggaagaagatgatccgcccccagcccatggagcaccggtacagctggaagtcctggggcaaggccaagatcatcggcgccgacatccagaacaccacgttcatcatcgacgggcccgacaccccggagtgccccgacgaccagcgcgcctggaacatctgggaggtggaggactacggcttcgggatcttcaccaccaacatctggctgaagctccgggacagctacacgcagatgtgcgaccaccgcctgatgtccgcggccatcaaggacagcaaggccgtccacgccgacatgggctactggatcgagtccgagaagaacgagacctggaagctggcccgggcgagcttcatcgaggtgaagacctgcatctggcccaagtcccacaccctctggagcaacggcgtgctggagtccgagatgatcatccccaagatctacgggggcccgatcagccagcacaactaccgccccgggtacttcacgcagaccgccggcccctggcacctggggaagctcgagctggacttcgacctgtgcgagggcaccaccgtcgtggtggacgagcactgcggcaaccgggggccgtccctccgcacgaccaccgtcaccggcaagatcatccacgagtggtgctgccggagctgcacgctgccgcccctgcgcttccgcggggaggacggctgctggtacgggatggagatccgccccgtgaaggagaaggaggagaacctcgtgcggtccatggtcagcgccggcagcggcgaggtggactccttcagcctggggatcctgtgcgtgtccatcatgatcgaggaggtcatgcgcagccggtggaaccgcaagatgctcatgaccggcaccctggccgtgttcctgctcctgatcatggggcagctgacctggaacgacctcatccgcctgtgcatcatggtgggcgccaacgcgtccgaccggatggggatgggcacgacctacctggccctcatggccaccttcaagatgcgcccgatgttcgccgtcggcctgctgttccggcgcctcaccagccgggaggtgctgctgctcacgatcgggctgtccctggtggccagcgtcgagctccccaactccctggaggagctgggcgacgggctcgcgatgggcatcatgatgctgaagctgctcaccgagttccagccccaccagctgtggaccaccctgctcagcctgacgttcatcaagaccaccctgtccctcgactacgcctggcgcaccatggccatggtgctgagcatcgtctccctgttccccctctgcctgagcacgacctcccagaagaccacctggctgccggtgctcctgggcagcttcgggtgcaagcccctgacgatgttcctcatcaccgagaacaagatctggggccggaagtcctggcccctgaacgaggggatcatggccatcggcatcgtgagcatcctgctctccagcctgctgaagaacgacgtccccctcgcggggccgctgatcgccggcggcatgctgatcgcctgctacgtgatcagcgggtccagcgccgacctctccctggagaaggccgcggaggtgagctgggaggaggaggccgagcactccggcaccagccacaacatcctggtcgaggtgcaggacgacgggaccatgaagatcaaggacgaggagcgcgacgacaccctcacgatcctgctgaaggccaccctcctggccgtgtccggcgtctaccccatgagcatccccgccaccctgttcgtgtggtacttctggcagaagaagaagcagcggtccggggtgctctgggacacccccagcccgcccgaggtcgagcgcgcggtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggccatcgcgctggacttcaagcccggcaccagcgggtccccgatcgtgaaccgggagggcaagatcgtcagcctgtacggcaacggggtggtgacgacctccggcacctacgtcagcgccatcgcccaggccaagaccagccaggaggggcccctccccgagatcgaggacgaggtgttcaagaagcgcaacctgacgatcatggacctgcacccgggctccgggaagacccggcgctacctccccgccatcgtgcgggaggcgatcaagcgcaagctgcgcaccctgatcctcgcccccacccgggtcgtggccagcgagatggccgaggcgctgaagggcatgcccatccgctaccagacgaccgccgtgaagtccgagcacaccggccgggagatcgtcgacctgatgtgccacgccaccttcacgatgcgcctcctgagcccggtgcgggtgcccaactacaacatgatcatcatggacgaggcccacttcaccgaccccgcctccatcgcggcccgcgggtacatcagcacccgggtcggcatgggggaggccgccgccatcttcatgaccgcgacgcccccgggctccgtggaggccttcccccagagcaacgccgtgatccaggacgaggagcgcgacatccccgagcggtcctggaacagcgggtacgactggatcaccgacttccccggcaagaccgtctggttcgtgccgtccatcaagagcggcaacgacatcgccaactgcctgcgcaagaacgggaagcgggtgatccagctctcccgcaagaccttcgacacggagtaccagaagaccaagaacaacgactgggactacgtcgtgaccaccgacatcagcgagatgggcgccaacttccgggcggaccgcgtgatcgacccccggcgctgcctgaagcccgtcatcctgaaggacgggcccgagcgggtgatcctcgccggcccgatgcccgtgacggtcgcctccgccgcgcagcgccgggggcgcatcggccgcaaccagaacaaggagggcgaccagtacgtgtacatggggcagcccctgaacaacgacgaggaccacgcccactggaccgaggccaagatgctgctcgacaacatcaacacccccgagggcatcatcccggccctgttcgagcccgagcgggagaagtccgccgcgatcgacggggagtaccgcctgcggggcgaggcccgcaagaccttcgtcgagctcatgcggcgcggggacctgcccgtgtggctgtcctacaaggtggccagcgagggcttccagtactccgaccggcgctggtgcttcgacggcgagcggaacaaccaggtcctcgaggagaacatggacgtggagatctggacgaaggagggggagcgcaagaagctgcggccccgctggctggacgcccggacctacagcgacccgctcgccctgcgcgagttcaaggagttcgcggccggccggcgcagcgtgtccggggacctgatcctcgagatcggcaagctgccccagcacctgaccctccgggcccagaacgccctggacaacctggtcatgctccacaacagcgagcagggcgggaaggcctaccgccacgcgatggaggagctgcccgacaccatcgagaccctgatgctcctggccctgatcgccgtgctcacgggcggggtgaccctgttcttcctgtccggcaaggggctcggcaagaccagcatcggcctgctgtgcgtcatggcctccagcgcgctcctgtggatggccaacgtggagccccactggatcgccgcctccatcatcctggagttcttcctcatggtgctgctgatcccggagcccgaccggcagcgcacgccccaggacaaccagctcgcctacgtcgtgatcgggctgctgttcatgatcctcacggtggcggccaacgagatgggcctgctggagaccaccaagaaggacctcgggatcggccacgtcgccgccgagaaccagcaccacgccaccatgctggacgtggacctgcggccggcgagcgcctggacgctctacgccgtggccaccaccgtcatcacccccatgatgcgccacacgatcgagaacaccaccgccaacatctccctgaccgcgatcgccaaccaggccgccatcctgatggggctcgacaagggctggcccatcagcaagatggacatcggcgtgcccctgctggccctcgggtgctactcccaggtgaacccgctgacgctgaccgcggccgtcctcatgctggtggcccactacgccatcatcggccccgggctgcaggcgaaggccacccgcgaggcccagaagcggaccgccgccggcatcatgaagaaccccacggtggacgggatcgtcgcgatcgacctcgaccccgtggtgtacgacgccaagttcgagaagcagctgggccagatcatgctgctcatcctgtgcaccagccagatcctgctcatgcgcaccacctgggccctgtgcgagtccatcacgctggccaccggcccgctcaccaccctgtgggaggggagccccggcaagttctggaacacgaccatcgccgtctccatggcgaacatcttccgggggagctacctggccggcgccggcctcgccttctccctgatgaagtccctcgggggcgggcgccgggggaccggggcccagggcgagaccctcggcgagaagtggaagcgccagctgaaccagctgtccaagagcgagttcaacacgtacaagcggagcgggatcatggaggtggaccgctccgaggcgaaggagggcctcaagcgcggggagaccaccaagcacgccgtgagccgcggcaccgccaagctgcggtggttcgtcgagcgcaacctggtgaagcccgaggggaaggtgatcgacctgggctgcggccgcggcgggtggtcctactactgcgccgggctcaagaaggtcacggaggtgaaggggtacaccaagggcgggcccggccacgaggagccgatccccatggcgacctacgggtggaacctggtgaagctgtacagcggcaaggacgtcttcttcacgccgcccgagaagtgcgacaccctcctgtgcgacatcggggagtccagcccgaaccccacgatcgaggagggccgcaccctgcgggtgctcaagatggtggagccctggctgcgcgggaaccagttctgcatcaagatcctgaacccctacatgccgtccgtcgtggagaccctcgagcagatgcagcggaagcacggcggcatgctggtgcgcaaccccctgagccggaactccacccacgagatgtactgggtcagctgcgggacgggcaacatcgtgtccgccgtgaacatgaccagccgcatgctcctgaaccgcttcaccatggcccaccggaagcccacctacgagcgcgacgtcgacctgggggccggcacgcggcacgtggccgtggagcccgaggtcgcgaacctcgacatcatcggccagcgcatcgagaacatcaagaacgagcacaagtccacctggcactacgacgaggacaacccgtacaagacctgggcctaccacgggagctacgaggtgaagccctccggcagcgcctccagcatggtgaacggggtcgtgcggctgctgaccaagccctgggacgtcatccccatggtgacgcagatcgccatgaccgacaccaccccgttcggccagcagcgcgtgttcaaggagaaggtcgacacgcggacgccccgggccaagcgggggaccgcgcagatcatggaggtgaccgccaagtggctctggggcttcctgtcccgcaacaagaagccccggatctgcacgcgcgaggagttcacccggaaggtgcgcagcaacgccgccatcggcgccgtcttcgtggacgagaaccagtggaacagcgcgaaggaggccgtggaggacgagcggttctgggacctggtctaccgcgagcgggagctccacaagcaggggaagtgcgcgacctgcgtgtacaacatgatgggcaagcgcgagaagaagctgggggagttcggcaaggccaaggggtcccgggcgatctggtacatgtggctgggcgcccgcttcctcgagttcgaggccctgggcttcatgaacgaggaccactggttcagccgggagaactccttcagcggggtggagggcgaggggctgcacaagctcggctacatcctgcgcgacatctccaagatccccgggggcaacatgtacgccgacgacaccgccggctgggacacgcgcatcaccgaggacgacctgcagaacgaggcgaagatcaccgacatcatggagcccgagcacgccctcctggccaccagcatcttcaagctgacgtaccagaacaaggtcgtgcgggtgcagcgccccgccaagaacgggaccgtcatggacgtgatctcccggcgcgaccagcggggcagcggccaggtggggacctacggcctcaacaccttcacgaacatggaggtccagctgatccgccagatggagtccgaggggatcttcctgcccagcgagctcgagaccccgaacctggccgagcgggtgctggactggctcgagaagcacggcaccgagcgcctgaagcggatggcgatctccggggacgactgcgtggtcaagcccgtggacgaccgcttcgccaccgccctgatcgccctcaacgacatgggcaaggtgcggaaggacatcccccagtgggagcccagcaaggggtggaacgactggcagcaggtcccgttctgctcccaccacttccaccagctgatcatgaaggacggccgcgagatcgtggtgccctgccggaaccaggacgagctggtcggccgcgcccgggtgagccagggggcgggctggtccctccgcgagacggcctgcctgggcaagagctacgcccagatgtggcagctgatgtacttccaccggcgcgacctccggctggccgccaacgcgatctgctccgccgtgcccgtcgactgggtgcccaccagccgcaccacctggagcatccacgcccaccaccagtggatgaccacggaggacatgctgtccgtgtggaaccgcgtctggatcgaggagaacccgtggatggaggacaagacccacgtgagctcctgggaggaggtgccctacctcggcaagcgggaggaccagtggtgcgggagcctgatcggcctgaccgcccgcgcgacctgggccacgaacatccaggtcgccatcaaccaggtgcggcgcctcatcggcaacgagaactacctggactacatgacctccatgaagcggttcaagaacgagagcgaccccgagggggccctgtggtga

SEQ ID NO: 8179 - RNA, 9879 nt, synthetic construct
  misc_feature 1..9879: note = derived and/or modified CDS sequence (opt1) from DENV-1__KJ189350__SS-prME
  source 1..9879: mol_type = other RNA
agcgtgaccatgctgctcatgctgctgcccaccgccctcgccttccacctgacgacccgcggcggggagccgcacatgatcgtctccaagcaggagcggggcaagagcctgctcttcaagacctccgcgggggtgaacatgtgcaccctgatcgccatggacctgggcgagctctgcgaggacacgatgacctacaagtgcccccgcatcaccgaggccgagcccgacgacgtggactgctggtgcaacgccaccgacacgtgggtcacctacgggacctgcagccagaacggcgagcaccggcgcgagaagcggtccgtggccctggcgccccacgtgggcctggggctcgagacccgcacggagacctggatgagctccgagggcgcctggaagcagatccagcgggtcgagacctgggccctgcgccacccggggttcaccgtgatcgccttcttcctggcgcacgccatcggcacgagcatcacccagaaggggatcatcttcatcctcctgatgctggtgaccccctccatggccatgcggtgcgtcggcatcggcaaccgcgacttcgtggaggggctcagcggcgccacctgggtggacgtcgtgctggagcacgggtcctgcgtgacgaccatggccaagaacaagcccaccctggacatcgagctcctgaagaccgaggtcacgaaccccgcggtgctgcggaagctctgcatcgaggccaagatcagcaacaccaccaccgactcccgctgcccgacgcagggcgaggccaccctggtggaggagcaggacgccaacttcgtctgccggcgcaccttcgtggaccggggctgggggaacggctgcgggctgttcggcaaggggagcctcctgacctgcgccaagttcaagtgcgtgacgaagctggagggcaagatcgtccagtacgagaacctcaagtactccgtgatcgtgaccgtccacaccggcgaccagcaccaggtggggaacgagaccacggagcacggcaccatcgcgaccatcaccccccaggcccccaccagcgagatccagctgacggactacggggccctgaccctcgactgctccccccgcaccggcctggacttcaacgagatggtcctgctcaccatgaaggagaagagctggctggtgcacaagcagtggttcctggacctcccgctgccctggacgtccggggccagcaccagccaggagacctggaaccggcaggacctgctcgtgaccttcaagacggcccacgcgaagaagcaggaggtcgtggtgctgggctcccaggagggcgccatgcacaccgccctgaccggggccaccgagatccagacgagcggcaccaccaccatcttcgccgggcacctcaagtgccgcctgaagatggacaagctgacgctcaagggcatgtcctacgtcatgtgcaccgggagcttcaagctggagaaggaggtggcggagacccagcacggcaccgtgctggtccaggtgaagtacgagggcacggacgccccctgcaagatccccttctccacccaggacgagaagggggtgacccagaacggccggctgatcaccgccaacccgatcgtcacggacaaggagaagcccgtgaacatcgagaccgagccccccttcggggagagctacatcgtggtcggcgccggcgagaaggcgctcaagctgtcctggttcaagcgcgggagctccatcggcaagatgttcgaggccaccgcccggggggcccgccgcatggccatcctgggcgacaccgcgtgggacttcgggagcatcggcggcgtgttcacgtccgtggggaagctcgtccaccagatcttcggcaccgcctacggggtgctgttcagcggcgtgtcctggaccatgaagatcgggatcggcatcctgctcacctggctgggcctgaacagccggtccacgagcctctccatgacctgcatcgccgtcgggatggtgaccctgtacctgggcgtgatggtccaggccgacagcgggtgcgtgatcaactggaagggccgcgagctcaagtgcgggtccggcatcttcgtgaccaacgaggtccacacgtggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtggtcgtgggggacgccaacggcatcctcgcgcaggggaagaagatgatccgcccccagcccatggagcacaagtactcctggaagagctggggcaaggccaagatcatcggcgccgacatccagaacaccacgttcatcatcgacgggcccgacaccccggagtgccccgacggccagcgggcctggaacatctgggaggtggaggactacgggttcggcgtcttcaccaccaacatctggctgaagctgcgcgactcctacacgcagatgtgcgaccaccggctcatgagcgcggccatcaaggactccaaggccgtgcacgccgacatgggctactggatcgagagcgagaagaacgagacctggaagctggcccgcgcgtccttcatcgaggtgaagacctgcacctggcccaagagccacacgctgtggtccaacggggtcctcgagagcgagatgatcatccccaagatctacggcgggccgatctcccagcacaactaccggcccggctacttcacccagaccgccgggccctggcacctgggcaagctggagctcgacttcgacctgtgcgagggcaccacggtggtggtcgacgagcactgcgggaaccgcggcccgagcctgcggaccaccaccgtgacggggaagatcatccacgagtggtgctgccgctcctgcaccctcccccccctgcggttccgcggcgaggacgggtgctggtacggcatggagatccggcccgtgaaggagaaggaggagaacctggtccgcagcatggtgtccgccggcagcggggaggtggacagcttctccctcggcatcctgtgcgtcagcatcatgatcgaggaggtgatgcggtcccgctggagccgcaagatgctgatgaccgggaccctcgccgtgttcctgctgctcatcatgggccagctgacgtggaacgacctgatccggctctgcatcatggtcggggccaacgcgtccgaccgcatgggcatgggcaccacctacctggccctgatggccaccttcaagatgcggccgatgttcgccgtggggctcctgttccgccggctgacgagccgcgaggtgctcctgctgaccatcggcctctccctggtcgccagcgtggagctgcccaactccctcgaggagctgggggacggcctggcgatgggcatcatgatgctcaagctgctgaccgagttccagccccaccagctctggaccacgctgctgagcctcaccttcgtcaagaccaccctgtccctggactacgcctggaagacgaccgccatggccctcagcatcgtgtccctgttccccctgtgcctcagcaccacctcccagaagacgacctggctgccggtgctgctcgggagcttcggctgcaagcccctgaccatgttcctgatcaccgagaacaagatctgggggcggaagtcctggcccctcaacgagggcatcatggcgatcgggatcgtcagcatcctgctgtccagcctcctgaagaacgacgtgcccctggccggcccgctcatcgccggcgggatgctgatcgcctgctacgtgatcagcggctccagcgccgacctgtccctcgagaaggcggccgaggtcagctgggagcaggaggccgagcactccggggccagccactccatcctggtggaggtgcaggacgacggcaccatgaagatcaaggacgaggagcgcgacgacacgctgaccatcctcctgaaggccaccctgctcgcggtcagcggggtgtaccccatgtccatccccgccaccctgttcgtgtggtacttctggcagaagaagaagcagcggagcggcgtcctgtgggacacgccctccccgcccgaggtggagcgcgccgtgctcgacaacggcatctaccggatcctgcagcgcgggctgctgggccggagccaggtcggggtgggcgtgttccaggacggggtcttccacaccatgtggcacgtgacccgcggcgccgtgctcatgtaccagggcaagcggctggagccctcctgggccagcgtcaagaaggacctgatctcctacgggggcgggtggcgcttccagggcagctggaacaccggggaggaggtgcaggtgatcgcggtcgagcccggcaagaacccgaagaacgtgcagacgacccccggcaccttcaagacccccgagggggaggtgggcgccatcgccctcgacttcaagcccgggacgtccggcagcccgatcgtcaaccgggagggcaagatcgtggggctgtacggcaacggggtggtcaccacctccggcacctacgtgagcgccatcgcccaggcgaaggccagccaggaggggcccctgcccgagatcgaggacgaggtgttcaagaagcgcaacctcacgatcatggacctgcacccgggctccggcaagacccggcgctacctgcccgccatcgtccgggaggccatcaagcgcaagctccgcaccctgatcctggcgcccacccgggtggtggccagcgagatggccgaggccctcaaggggatgcccatccgctaccagacgaccgccgtcaagtccgagcacaccggccgggagatcgtggacctgatgtgccacgcgaccttcacgatgcgcctgctcagcccggtgcgggtccccaactacaacatgatcatcatggacgaggcccacttcaccgaccccgcctccatcgccgcccgcgggtacatcagcacccgggtgggcatgggggaggcggccgccatcttcatgaccgccacgcccccgggctccgtggaggccttcccccagagcaacgcggtcatccaggacgaggagcgcgacatccccgagcggtcctggaacagcggctacgactggatcaccgacttccccgggaagaccgtgtggttcgtgccgtccatcaagagcggcaacgacatcgccaactgcctgcgcaagaacgggaagcgggtcatccagctgtcccgcaagaccttcgacacggagtaccagaagaccaagaacaacgactgggactacgtggtgaccaccgacatcagcgagatgggcgccaacttccgggccgaccgcgtcatcgacccccggcgctgcctcaagcccgtgatcctgaaggacgggcccgagcgggtgatcctggcgggcccgatgcccgtcacggccgcctccgccgcccagcgccggggccgcatcgggcgcaaccagaacaaggagggcgaccagtacgtgtacatggggcagcccctcaacaacgacgaggaccacgcgcactggaccgaggccaagatgctgctggacaacatcaacacccccgagggcatcatcccggccctcttcgagcccgagcgggagaagagcgccgccatcgacggggagtaccgcctgcggggcgaggcgcgcaagaccttcgtcgagctgatgcggcgcggcgacctccccgtgtggctgtcctacaaggtggccagcgaggggttccagtactccgaccggcgctggtgcttcgacggcgagcggaacaaccaggtcctggaggagaacatggacgtggagatctggacgaaggagggggagcgcaagaagctccggccccgctggctggacgcccggacctacagcgacccgctggccctccgcgagttcaaggagttcgccgcgggccggcgcagcgtgtccggcgacctgatcctggagatcgggaagctcccccagcacctgaccctgcgggcccagaacgccctcgacaacctggtcatgctgcacaacagcgagcagggcgggaaggcctaccgccacgcgatggaggagctccccgacaccatcgagaccctgatgctgctcgccctgatcgccgtgctgacgggcggggtgaccctcttcttcctgtccggcaagggcctggggaagaccagcatcggcctcctgtgcgtcaccgcctccagcgccctgctctggatggcgtccgtggagccccactggatcgccgccagcatcatcctggagttcttcctgatggtgctcctgatcccggagcccgaccggcagcgcacgccccaggacaaccagctggcctacgtcgtgatcgggctcctgttcatgatcctgaccgtggccgcgaacgagatgggcctcctggagaccaccaagaaggacctggggatcggctacgtcgccgccgagaaccaccagcacgccacgatgctcgacgtggacctgcacccggcctccgcgtggaccctgtacgccgtggccaccaccgtcatcacgcccatgatgcggcacaccatcgagaacaccaccgccaacatcagcctcacggccatcgcgaaccaggccgccatcctgatgggcctggacaaggggtggcccatctccaagatggacatcggcgtgcccctcctggccctggggtgctacagccaggtgaacccgctcaccctgaccgcggccgtcctgatgctcgtggcccactacgccatcatcggccccgggctgcaggccaaggcgacccgcgaggcccagaagcgcacggccgccggcatcatgaagaaccccaccgtggacggcatcgtcgccatcgacctggaccccgtggtgtacgacgcgaagttcgagaagcagctcgggcagatcatgctgctgatcctctgcacctcccagatcctgctgatgcggaccacgtgggccctctgcgagagcatcaccctggccaccggcccgctgaccacgctctgggaggggtcccccggcaagttctggaacaccaccatcgccgtcagcatggccaacatcttccgcggctcctacctggcgggggccggcctggccttcagcctcatgaagtccctggggggcgggcggcgcggcaccggcgcccagggggagacgctgggcgagaagtggaagcggcagctcaaccagctgagcaagagcgagttcaacacctacaagcgctccgggatcatggaggtggaccggagcgaggcgaaggagggcctgaagcgcggggagaccaccaagcacgccgtgtcccggggcacggccaagctccgctggttcgtcgagcggaacctggtgaagcccgagggcaaggtgatcgacctggggtgcggccgcgggggctggagctactactgcgccgggctgaagaaggtcaccgaggtgaagggctacaccaagggcgggcccggccacgaggagccgatccccatggccacctacgggtggaacctcgtgaagctgcactccggcaaggacgtcttcttcatgccccccgagaagtgcgacaccctgctctgcgacatcggggagagctccccgaaccccacgatcgaggagggccggaccctgcgcgtgctgaagatggtggagccctggctccggggcaaccagttctgcatcaagatcctgaacccctacatgccgagcgtcgtggagaccctggagcgcatgcagcggaagcacgggggcatgctcgtgcgcaaccccctgtcccggaacagcacccacgagatgtactgggtctcctgcgggacgggcaacatcgtgagcgcggtgaacatgacctcccgcatgctgctcaaccgcttcaccatggcccaccggaagcccacctacgagcgcgacgtcgacctgggcgccgggacgcggcacgtggccgtggagcccgaggtcgccaacctggacatcatcggccagcgcatcgagaacatcaagaacgagcacaagagcacctggcactacgacgaggacaacccgtacaagacctgggcgtaccacgggtcctacgaggtgaagcccagcggctccgccagctccatggtgaacggggtcgtgcggctcctgaccaagccctgggacgtcatccccatggtgacgcagatcgccatgaccgacaccaccccgttcggccagcagcgcgtgttcaaggagaaggtcgacacgcggaccccccgcgccaagcggggcaccacccagatcatggaggtgacggccaagtggctgtgggggttcctcagccgcaacaagaagccccggatctgcacccgcgaggagttcacccggaaggtgcgcagcaacgcggccatcggcgccgtcttcgtggacgagaaccagtggaactccgccaaggaggcggtggaggacgagcggttctgggacctggtccaccgcgagcgggagctgcacaagcaggggaagtgcgccacctgcgtgtacaacatgatgggcaagcgcgagaagaagctcggggagttcggcaaggccaagggcagccgggccatctggtacatgtggctgggggcccgcttcctggagttcgaggcgctcggcttcatgaacgaggaccactggttctcccgggagaacagcctgtccggggtggagggcgaggggctgcacaagctcggctacatcctgcgcgacatcagcaagatcccgggcgggaacatgtacgccgacgacacggccggctgggacacccgcgtcaccgaggacgacctgcagaacgaggccaagatcaccgacatcatggagcccgagcacgccctcctggcgacgtccatcttcaagctgacctaccagaacaaggtggtgcgggtccagcgccccgccaagaacgggaccgtgatggacgtgatcagccggcgcgaccagcggggctccggccaggtcgggacctacggcctcaacacgttcaccaacatggaggtgcagctgatccgccagatggagagcgaggggatcttcctgccctccgagctcgagaccccgaacctggccgagcgggccctggactggctcgagaagcacggcgccgagcgcctgaagcggatggcgatcagcggggacgactgcgtggtcaagcccatcgacgaccgcttcgccaccgccctgacggccctcaacgacatgggcaaggtgcggaaggacatcccccagtgggagccctccaagggctggaacgactggcagcaggtgccgttctgcagccaccacttccaccagctgatcatgaaggacgggcgcgagatcgtcgtgccctgccggaaccaggacgagctggtgggccgcgcccgggtctcccagggggcgggctggagcctccgcgagaccgcctgcctggggaagtcctacgcccagatgtggcagctgatgtacttccaccggcgcgacctccggctggccgcgaacgccatctgcagcgccgtgcccgtggactgggtccccaccagccgcaccacctggtccatccacgcccaccaccagtggatgacgaccgaggacatgctgagcgtgtggaaccgcgtgtggatcgaggagaacccgtggatggagaacaagacccacgtctccagctgggaggaggtgccctacctcggcaagcgggaggaccagtggtgcggctccctgatcgggctgaccgcccgcgcgacgtgggccaccaacatccaggtggccatcaaccaggtccggcgcctcatcggcaacgagaactacctggactacatgaccagcatgaagcggttcaagaacgagtccgacagcgagggggccctgtggtga

SEQ ID NO: 8180 - RNA, 9879 nt, synthetic construct
  misc_feature 1..9879: note = derived and/or modified CDS sequence (opt1) from DENV-1__KJ189351__SS-prME
  source 1..9879: mol_type = other RNA
agcgtgaccatgctgctcatgctgctgcccaccgtgctcgccttccacctgaccacccggggcggggagccccacatgatcgtgagcaagcaggagcggggcaagagcctcctgttcaagaccagcgccggggtgaacatgtgcaccctgatcgcgatggacctgggcgagctctgcgaggacaccatgacctacaagtgcccccgcatcaccgaggccgagcccgacgacgtggactgctggtgcaacgccaccgacacgtgggtgacctacgggacctgcagccagaccggcgagcaccggcgggagaagcggtccgtggccctggcgccccacgtcggcctggggctcgagacgcgcaccgagacctggatgagctccgagggcgcctggaagcagatccagcgggtggagacctgggccctgcgccaccccgggttcacggtgatcgccttcttcctggcccacgcgatcggcaccagcatcacccagaaggggatcatcttcatcctcctgatgctggtgaccccctccatggccatgcggtgcgtgggcatcggcaaccgcgacttcgtggaggggctcagcggcgccacgtgggtcgacgtggtgctggagcacgggtcctgcgtcaccaccatggccaagaacaagcccaccctggacatcgagctcctgaagacggaggtgaccaaccccgccgtgctgcggaagctctgcatcgaggcgaagatcagcaacaccaccacggactcccgctgcccgacccagggcgaggccaccctggtcgaggagcaggacgccaacttcgtgtgccggcgcaccttcgtggaccggggctgggggaacggctgcgggctgttcggcaaggggagcctcctgacgtgcgccaagttcaagtgcgtcaccaagctggagggcaagatcgtgcagtacgagaacctcaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctgaccctcgactgcagcccccggaccggcctggacttcaacgagatggtgctgctcacgatgaaggagaagtcctggctggtgcacaagcagtggttcctggacctcccgctgccctggacccccggggcctccaccagccaggagacctggaaccggcaggacctgctcgtcacgttcaagaccgcccacgccaagaagcaggaggtggtggtcctgggcagccaggagggcgcgatgcacaccgccctgaccggggccacggagatccagacctccggcaccaccacgatcttcgccgggcacctcaagtgccgcctgaagatggacaagctgaccctcaagggcatgagctacgtgatgtgcaccgggtccttcaagctggagaaggaggtggccgagacccagcacggcacggtcctggtccaggtgaagtacgagggcaccgacgcgccctgcaagatcccgttcagcacccaggacgagaagggggtcacccagaacggccggctgatcacggccaaccccatcgtgaccgacaaggagaagcccgtgaacatcgagaccgagcccccgttcggggagtcctacatcgtcgtgggcgccggcgagaaggccctcaagctgagctggttcaagcgcgggtccagcatcggcaagatgttcgaggcgaccgcccgcggggcccgccgcatggccatcctgggcgacacggcctgggacttcgggtccatcggcggcgtgttcaccagcgtcgggaagctcgtgcaccaggtgttcggcaccgcgtacggggtcctgttctccggcgtgagctggaccatgaagatcgggatcggcatcctgctcacgtggctgggcctgaactcccggagcacctccctcagcatgacctgcatcgccgtggggatggtcaccctgtacctgggcgtgatggtgcaggccgactccgggtgcgtcatcaactggaagggccgcgagctcaagtgcgggagcggcatcttcgtgacgaacgaggtgcacacctggaccgagcagtacaagttccaggccgactcccccaagcggctgagcgccgcgatcggcaaggcctgggaggagggggtctgcggcatccgcagcgccacccggctggagaacatcatgtggaagcagatctccaacgagctcaaccacatcctgctggagaacgacatgaagttcaccgtggtggtcggggacgccaacggcatcctcgcccaggggaagaagatgatccgcccccagcccatggagcacaagtacagctggaagtcctggggcaaggcgaagatcatcggcgccgacatccagaacacgaccttcatcatcgacgggccggacacccccgagtgccccgacggccagcgggcctggaacatctgggaggtggaggactacgggttcggcgtgttcaccacgaacatctggctgaagctgcgcgacagctacacccagatgtgcgaccaccggctcatgtccgccgcgatcaaggacagcaaggccgtccacgccgacatgggctactggatcgagtccgagaagaacgagacctggaagctggcccgcgccagcttcatcgaggtgaagacctgcacgtggcccaagtcccacaccctgtggagcaacggggtgctcgagtccgagatgatcatcccgaagatctacggcgggcccatcagccagcacaactaccggcccggctacttcacccagaccgcggggccgtggcacctgggcaagctggagctcgacttcgacctgtgcgagggcacgaccgtcgtggtggacgagcactgcgggaaccgcggcccctccctgcggaccaccacggtcaccgggaagatcatccacgagtggtgctgccgcagctgcaccctgccgcccctgcggttccgcggcgaggacgggtgctggtacggcatggagatccggccggtgaaggagaaggaggagaacctggtgcgctccatggtcagcgccggctccggggaggtggacagcttcagcctcggcatcctgtgcgtgtccatcatgatcgaggaggtcatgcggagccgctggtcccgcaagatgctgatgaccgggacgctcgccgtgttcctgctgctcatcatgggccagctgacctggaacgacctgacccggctctgcatcatggtgggggccaacgccagcgaccgcatgggcatgggcaccacgtacctggcgctgatggccaccttcaagatgcggcccatgttcgccgtcgggctcctgttccgccggctgacctcccgcgaggtgctcctgctgaccatcggcctcagcctggtcgcctccgtggagctgcccaacagcctcgaggagctgggggacggcctggccatgggcatcatgatgctcaagctgctgacggagttccagccccaccagctctggaccaccctgctgtccctcaccttcgtgaagacgaccctgagcctggactacgcgtggaagaccaccgccatggccctctccatcgtcagcctgttcccgctgtgcctctccacgaccagccagaagaccacctggctgcccgtgctgctcgggtccttcggctgcaagcccctgaccatgttcctgatcgccgagaaccggatctgggggcgcaagagctggcccctcaacgagggcatcatggcgatcgggatcgtgtccatcctgctgagctccctcctgaagaacgacgtcccgctggccggccccctcatcgccggcgggatgctgatcgcctgctacgtgatcagcggcagctccgccgacctgagcctcgagaaggcggccgaggtgtcctgggagcaggaggccgagcacagcggggcctcccacagcatcctggtcgaggtgcaggacgacggcacgatgaagatcaaggacgaggagcgggacgacaccctgaccatcctcctgaaggccaccctgctcgcggtgtccggggtctaccccatgagcatccccgccacgctgttcgtgtggtacttctggcagaagaagaagcagcgctccggcgtgctgtgggacaccccgtccccgcccgaggtcgagcgggccgtgctcgacaacggcatctaccgcatcctgcagcgggggctgctgggccgctcccaggtgggggtcggcgtgttccaggacggggtgttccacaccatgtggcacgtcacccggggcgccgtgctcatgtaccagggcaagcgcctggagcccagctgggcctccgtgaagaaggacctgatcagctacgggggcgggtggcggttccagggctcctggaacacgggggaggaggtccaggtgatcgcggtggagccgggcaagaaccccaagaacgtccagaccacccccggcaccttcaagacgcccgagggggaggtgggcgccatcgccctcgacttcaagccggggaccagcggctcccccatcgtgaaccgcgagggcaagatcgtcgggctgtacggcaacggggtggtgaccaccagcggcacgtacgtctccgccatcgcccaggcgaaggccagccaggaggggcccctgccggagatcgaggacgaggtgttcaagaagcggaacctcaccatcatggacctgcaccccggcagcggcaagacccgccggtacctgcccgccatcgtgcgcgaggccatcaagcgcaagctccggaccctgatcctggcgcccacgcgcgtcgtggcctccgagatggccgaggccctcaaggggatgccgatccggtaccagaccaccgccgtcaagagcgagcacaccggccgcgagatcgtcgacctgatgtgccacgcgacgttcaccatgcggctgctctcccccgtgcgcgtgcccaactacaacatgatcatcatggacgaggcccacttcaccgaccccgccagcatcgccgcccgggggtacatctccacccgcgtcggcatgggggaggcggccgccatcttcatgacggccaccccgcccggcagcgtggaggccttcccccagtccaacgcggtgatccaggacgaggagcgggacatccccgagcgcagctggaactccggctacgactggatcaccgacttcccggggaagaccgtctggttcgtgcccagcatcaagtccggcaacgacatcgccaactgcctgcggaagaacgggaagcgcgtgatccagctgagccggaagacgttcgacaccgagtaccagaagaccaagaacaacgactgggactacgtcgtgaccacggacatctccgagatgggcgccaacttccgcgccgaccgggtgatcgacccccgccggtgcctcaagcccgtcatcctgaaggacgggccggagcgcgtgatcctggcgggccccatgcccgtcaccgtggccagcgccgcccagcggcgcggccgcatcgggcggaaccagaacaaggagggcgaccagtacgtgtacatggggcagcccctcaacaacgacgaggaccacgcccactggaccgaggcgaagatgctgctggacaacatcaacaccccggagggcatcatccccgccctcttcgagcccgagcgcgagaagtccgccgccatcgacggggagtaccggctgcgcggcgaggcccggaagacgttcgtcgagctgatgcgccggggcgacctccccgtgtggctgagctacaaggtggcgtccgaggggttccagtacagcgaccgccggtggtgcttcgacggcgagcgcaacaaccaggtcctggaggagaacatggacgtggagatctggaccaaggagggggagcggaagaagctccgcccgcggtggctggacgcccgcacctactccgaccccctggccctccgggagttcaaggagttcgccgccggccgccggagcgtgagcggcgacctgatcctggagatcgggaagctcccccagcacctgaccctgcgcgcgcagaacgccctcgacaacctggtcatgctgcacaactccgagcagggcgggaaggcctaccggcacgccatggaggagctccccgacaccatcgagacgctgatgctgctcgcgctgatcgccgtgctgaccggcggggtgaccctcttcttcctgagcggcaagggcctggggaagacctccatcggcctcctgtgcgtcacggccagctccgccctgctctggatggccagcgtggagccgcactggatcgcggcctccatcatcctggagttcttcctgatggtgctcctgatccccgagcccgaccgccagcggaccccgcaggacaaccagctggcctacgtcgtgatcgggctcctgttcatgatcctgaccgtggccgccaacgagatgggcctcctggagaccacgaagaaggacctggggatcggctacgtcgcggccgagaaccaccagcacgccaccatgctcgacgtggacctgcaccccgccagcgcctggaccctgtacgcggtggccaccacggtcatcacccccatgatgcgccacaccatcgagaacaccacggccaacatctccctcaccgccatcgccaaccaggcggccatcctgatgggcctggacaaggggtggcccatcagcaagatggacatcggcgtgccgctcctggccctggggtgctactcccaggtgaaccccctcaccctgaccgccgcggtcctgatgctcgtggcccactacgccatcatcggccccgggctgcaggccaaggccacgcgcgaggcgcagaagcggaccgccgccggcatcatgaagaaccccaccgtggacggcatcgtcgccatcgacctggacccggtggtgtacgacgccaagttcgagaagcagctcgggcagatcatgctgctgatcctctgcaccagccagatcctgctgatgcgcacgacctgggcgctctgcgagtccatcaccctggccaccggccccctgacgaccctctgggaggggagccccggcaagttctggaacaccaccatcgccgtctccatggccaacatcttccggggcagctacctggccggggcgggcctggccttctccctcatgaagtccctcgggggcgggcgccggggcacgggcgcccagggggagaccctgggcgagaagtggaagcgccagctcaaccagctgtccaagagcgagttcaacatctacaagcggagcgggatcatggaggtggaccgctccgaggccaaggagggcctgaagcgcggggagaccaccaagcacgcggtgagccgcggcacggccaagctccggtggttcgtcgagcgcaacctggtgaagcccgagggcaaggtgatcgacctggggtgcggccgcgggggctggtcctactactgcgccgggctgaagaaggtcaccgaggtgaagggctacaccaagggcgggccgggccacgaggagcccatccccatggccacctacgggtggaacctcgtgaagctgcacagcggcaaggacgtcttcttcatgcccccggagaagtgcgacaccctgctctgcgacatcggggagtccagccccaaccccacgatcgaggagggccgcaccctgcgggtgctgaagatggtggagccctggctccgcggcaaccagttctgcgtcaagatcctgaacccgtacatgccctccgtggtggagaccctggagcggatgcagcgcaagcacgggggcatgctcgtccggaaccccctgagccgcaactccacccacgagatgtactgggtgagctgcgggacgggcaacatcgtgtccgccgtcaacatgaccagccgcatgctgctcaaccggttcaccatggcgcaccgcaagcccacctacgagcgggacgtggacctgggcgccgggacgcgccacgtggccgtcgagccggaggtggccaacctggacatcatcggccagcggatcgagaacatcaagaacgagcacaagtccacctggcactacgacgaggacaacccctacaagacctgggcctaccacgggagctacgaggtcaagtccagcggctccgcgagctccatggtgaacggggtggtccgcctcctgaccaagccctgggacgtgatccccatggtgacgcagatcgccatgaccgacaccaccccgttcggccagcagcgggtcttcaaggagaaggtggacacgcgcacgccccgggccaagcgcggcaccacccagatcatggaggtgacggccaagtggctgtgggggttcctcagccggaacaagaagccccgcatctgcacccgggaggagttcacccgcaaggtccggagcaacgccgcgatcggcgccgtgttcgtggacgagaaccagtggaactccgccaaggaggccgtcgaggacgagcgcttctgggacctggtgcaccgggagcgcgagctgcacaagcaggggaagtgcgcgacctgcgtgtacaacatgatgggcaagcgggagaagaagctcggggagttcggcaaggccaagggcagccgcgccatctggtacatgtggctgggggcccggttcctggagttcgaggccctcggcttcatgaacgaggaccactggttctcccgcgagaacagcctgtccggggtcgagggcgaggggctgcacaagctcggctacatcctgcgcgacatcagcaagatcccgggcgggaacatgtacgcggacgacacggccggctgggacacccggatcaccgaggacgacctgcagaacgaggccaagatcaccgacatcatggagcccgagcacgccctcctggccacgtccatcttcaagctgacctaccagaacaaggtggtgcgcgtccagcggcccgcgaagaacgggaccgtgatggacgtgatcagccgccgggaccagcgcggctccggccaggtcgggacctacggcctcaacacgttcaccaacatggaggtgcagctgatccggcagatggagagcgaggggatcttcctgccctccgagctcgagaccccgaacctggccgagcgcgccctggactggctcgagaagcacggcgccgagcggctgaagcgcatggccatcagcggggacgactgcgtggtcaagcccatcgacgaccggttcgcgaccgccctgacggccctcaacgacatgggcaaggtgcgcaaggacatcccccagtgggagccctccaagggctggaacgactggcagcaggtcccgttctgcagccaccacttccaccagctgatcatgaaggacgggcgggagatcgtcgtgccctgccgcaaccaggacgagctggtgggccgggcccgcgtctcccagggggccggctggagcctccgggagaccgcgtgcctggggaagtcctacgcccagatgtggcagctgatgtacttccaccgccgggacctccgcctggccgccaacgcgatctgcagcgccgtgcccgtggactgggtccccaccagccgcaccacctggtccatccacgcccaccaccagtggatgacgaccgaggacatgctgagcgtgtggaaccgggtgtggatcgaggagaacccgtggatggaggacaagacccacgtctccagctgggaggaggtgccctacctcggcaagcgcgaggaccagtggtgcggctccctgatcgggctgaccgcccgggccacgtgggcgaccaacatccaggtggccatcaaccaggtccgccggctcatcggcaacgagaactacctggactacatgaccagcatgaagcgcttcaagaacgagtccgacagcgagggggccctgtggtga

SEQ ID NO: 8181 - RNA, 9879 nt, synthetic construct
  misc_feature 1..9879: note = derived and/or modified CDS sequence (opt1) from DENV-1__KJ189352__SS-prME
  source 1..9879: mol_type = other RNA
agcgtgaccatgctgctcatgctgctgcccaccgccctcgccttccacctgaccacccggggcggggagccccacatgatcgtcagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgggagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctcgtccaccagatcttcggcaccgcctacggggtgctgttcagcggcgtgtcctggaccatgaagatcgggatcggcatcctgctcacgtggctgggcctgaacagccggtccaccagcctctccatgacctgcatcgccgtcgggatggtgaccctgtacctgggcgtgatggtccaggccgacagcgggtgcgtgatcaactggaagggccgcgagctcaagtgcgggtccggcatcttcgtgacgaacgaggtccacacctggaccgagcagtacaagttccaggccgacagcccgaagcggctgagcgcggccatcggcaaggcctgggaggagggggtgtgcggcatccgctccgccacccggctggagaacatcatgtggcgccagatcagcaacgagctcaaccacatcctgctggagaacgacatgaagttcaccgtggtcgtgggggacgccaacggcatcctcgcgcaggggaagaagatgatccggccccagcccatggagcacaagtactcctggaagtcctggggcaaggccaaggtgatcggcgccgacatccagaacacgaccttcatcatcgacgggcccgacaccccggagtgccccgacggccagcgcgcctggaacatctgggaggtcgaggactacgggttcggcgtgttcaccacgaacatctggctgaagctgcgggactcctacacccagatgtgcgaccaccgcctcatgagcgcggccatcaaggactccaaggccgtgcacgccgacatgggctactggatcgagagcgagaagaacgagacctggaagctggcccgggcgtccttcatcgaggtcaagacctgcacgtggcccaagagccacaccctgtggtccaacggggtgctcgagagcgagatgatcatccccaagatctacggcgggccgatctcccagcacaactaccgccccggctacttcacccagaccgccgggccctggcacctgggcaagctggagctcgacttcgacctgtgcgagggcacgaccgtggtcgtggacgagcactgcgggaaccggggcccgagcctgcgcaccaccacggtgaccgggaagatcatccacgagtggtgctgccggtcctgcaccctgccgcccctgcgcttccggggcgaggacgggtgctggtacggcatggagatccgccccgtcaaggagaaggaggagaacctggtgcggagcatggtgtccgccggcagcggggaggtcgacagcttctccctcggcatcctgtgcgtgagcatcatgatcgaggaggtgatgcgctcccgctggagccggaagatgctgatgaccgggacgctcgccgtcttcctgctgctcatcatgggccagctgacctggaacgacctgatccgcctctgcatcatggtgggggccaacgcgtccgaccggatgggcatgggcaccacctacctggccctgatggccacgttcaagatgcgcccgatgttcgccgtggggctcctgttccggcgcctgaccagccgggaggtcctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatggccctcagcatcgtgtccctgttccccctgtgcctcagcaccacgtcccagaagaccacctggctgccggtcctgctcgggagcttcggctgcaagcccctgaccatgttcctgatcaccgagaacaagatctgggggcgcaagtcctggcccctcaacgagggcatcatggcgatcgggatcgtgagcatcctgctgtccagcctcctgaagaacgacgtgcccctggccggcccgctcatcgccggcgggatgctgatcgcctgctacgtcatcagcggctccagcgccgacctgtccctcgagaaggcggccgaggtgagctgggagcaggaggccgagcactccggggccagccactccatcctggtggaggtccaggacgacggcacgatgaagatcaaggacgaggagcgggacgacaccctgaccatcctcctgaaggccaccctgctcgcggtgagcggggtgtaccccatgtccatccccgccacgctgttcgtctggtacttctggcagaagaagaagcagcgcagcggcgtgctgtgggacaccccctccccgcccgaggtggagcgggccgtcctcgacaacggcatctaccgcatcctgcagcgggggctgctgggccgcagccaggtgggggtgggcgtcttccaggacggggtgttccacaccatgtggcacgtgacccggggcgccgtcctcatgtaccagggcaagcgcctggagccctcctgggccagcgtgaagaaggacctgatctcctacgggggcgggtggcggttccagggcagctggaacacgggggaggaggtgcaggtcatcgcggtggagcccggcaagaacccgaagaacgtgcagaccacccccggcaccttcaagacgcccgagggggaggtcggcgccatcgccctcgacttcaagcccgggacctccggcagcccgatcgtgaaccgcgagggcaagatcgtggggctgtacggcaacggggtcgtgaccacctccggcacgtacgtgagcgccatcgcccaggcgaaggccagccaggaggggcccctgcccgagatcgaggacgaggtcttcaagaagcggaacctcaccatcatggacctgcacccgggctccggcaagacccgccggtacctgcccgccatcgtgcgcgaggccatcaagcgcaagctccggaccctgatcctggcgcccacgcgcgtggtcgccagcgagatggccgaggccctcaaggggatgcccatccggtaccagaccaccgccgtgaagtccgagcacaccggccgcgagatcgtggacctgatgtgccacgcgacgttcaccatgcggctgctcagcccggtccgcgtgcccaactacaacatgatcatcatggacgaggcccacttcaccgaccccgcctccatcgccgcccgggggtacatcagcacccgcgtgggcatgggggaggcggccgccatcttcatgacggccacgccgcccggctccgtcgaggccttcccccagagcaacgcggtgatccaggacgaggagcgggacatccccgagcgctcctggaacagcggctacgactggatcaccgacttccccgggaagaccgtgtggttcgtcccctccatcaagagcggcaacgacatcgccaactgcctgcggaagaacgggaagcgcgtgatccagctgtcccggaagacgttcgacaccgagtaccagaagaccaagaacaacgactgggactacgtggtcaccacggacatcagcgagatgggcgccaacttccgcgccgaccgggtgatcgacccccgccggtgcctcaagcccgtgatcctgaaggacgggcccgagcgcgtcatcctggcgggcccgatgcccgtgaccgccgcctccgccgcccagcggcgcggccgcatcgggcggaaccagaacaaggagggcgaccagtacgtctacatggggcagcccctcaacaacgacgaggaccacgcgcactggaccgaggccaagatgctgctggacaacatcaacacccccgagggcatcatcccggccctcttcgagcccgagcgcgagaagtccgccgccatcgacggggagtaccggctgcgcggcgaggcgcggaagacgttcgtggagctgatgcgccggggcgacctccccgtgtggctgtcctacaaggtcgccagcgaggggttccagtactccgaccgccggtggtgcttcgacggcgagcgcaacaaccaggtgctggaggagaacatggacgtggagatctggaccaaggagggggagcggaagaagctccgcccccggtggctggacgcccgcacctacagcgacccgctggccctccgggagttcaaggagttcgccgcgggccgccggagcgtctccggcgacctgatcctggagatcgggaagctcccccagcacctgaccctgcgcgcccagaacgccctcgacaacctggtgatgctgcacaacagcgagcagggcgggaaggcctaccggcacgcgatggaggagctccccgacaccatcgagacgctgatgctgctcgccctgatcgccgtgctgaccggcggggtcaccctcttcttcctgtccggcaagggcctggggaagaccagcatcggcctcctgtgcgtgacggcctccagcgccctgctctggatggcgtccgtggagccccactggatcgccgccagcatcatcctggagttcttcctgatggtcctcctgatcccggagcccgaccgccagcggacgccccaggacaaccagctggcctacgtggtgatcgggctcctgttcatgatcctgaccgtcgccgcgaacgagatgggcctcctggagaccacgaagaaggacctggggatcggctacgtggccgccgagaaccaccagcacgccaccatgctcgacgtggacctgcacccggcctccgcgtggaccctgtacgccgtcgccaccacggtgatcacccccatgatgcgccacaccatcgagaacaccacggccaacatcagcctcaccgccatcgcgaaccaggccgccatcctgatgggcctggacaaggggtggcccatctccaagatggacatcggcgtgcccctcctggccctggggtgctacagccaggtcaacccgctcaccctgaccgcggccgtgctgatgctcgtggcccactacgccatcatcggccccgggctgcaggccaaggcgacgcgcgaggcccagaagcggaccgccgccggcatcatgaagaaccccaccgtcgacggcatcgtggccatcgacctggaccccgtggtctacgacgcgaagttcgagaagcagctcgggcagatcatgctgctgatcctctgcacctcccagatcctgctgatgcgcacgacctgggccctctgcgagagcatcaccctggccaccggcccgctgacgaccctctgggaggggtcccccggcaagttctggaacaccaccatcgccgtgagcatggccaacatcttccggggctcctacctggcgggggccggcctggccttcagcctcatgaagtccctcgggggcgggcgccggggcacgggcgcccagggggagaccctgggcgagaagtggaagcgccagctcaaccagctgagcaagagcgagttcaacacctacaagcggtccgggatcatggaggtggaccgcagcgaggcgaaggagggcctgaagcgcggggagaccacgaagcacgccgtctcccgcggcaccgccaagctccggtggttcgtggagcgcaacctggtgaagcccgagggcaaggtcatcgacctggggtgcggccgcgggggctggagctactactgcgccgggctgaagaaggtgaccgaggtgaagggctacaccaagggcgggcccggccacgaggagccgatccccatggccacctacgggtggaacctcgtcaagctgcactccggcaaggacgtgttcttcatgccgcccgagaagtgcgacacgctgctctgcgacatcggggagagctccccgaaccccaccatcgaggagggccgcaccctgcgggtgctgaagatggtcgagccctggctccgcggcaaccagttctgcatcaagatcctgaacccctacatgccgagcgtggtggagaccctggagcggatgcagcgcaagcacgggggcatgctcgtccggaaccccctgtcccgcaacagcacgcacgagatgtactgggtgtcctgcgggaccggcaacatcgtgagcgcggtcaacatgacctcccgcatgctgctcaaccggttcaccatggcccaccgcaagcccacgtacgagcgggacgtggacctgggcgccgggacccgccacgtggccgtcgagcccgaggtggccaacctggacatcatcggccagcggatcgagaacatcaagaacgagcacaagagcacctggcactacgacgaggacaacccgtacaagacctgggcgtaccacgggtcctacgaggtgaagcccagcggctccgccagctccatggtcaacggggtggtccgcctcctgacgaagccctgggacgtgatccccatggtgacccagatcgccatgaccgacaccacgccgttcggccagcagcgggtcttcaaggagaaggtggacacccgcacgccccgggccaagcgcggcaccacgcagatcatggaggtgaccgccaagtggctgtgggggttcctcagccggaacaagaagccccgcatctgcacccgggaggagttcacccgcaaggtccggagcaacgcggccatcggcgccgtgttcgtggacgagaaccagtggaactccgccaaggaggcggtcgaggacgagcgcttctgggacctggtgcaccgggagcgcgagctgcacaagcaggggaagtgcgccacgtgcgtgtacaacatgatgggcaagcgggagaagaagctcggggagttcggcaaggccaagggcagccgcgccatctggtacatgtggctgggggcccggttcctggagttcgaggcgctcggcttcatgaacgaggaccactggttctcccgcgagaacagcctgtccggggtcgagggcgaggggctgcacaagctcggctacatcctgcgcgacatcagcaagatcccgggcgggaacatgtacgccgacgacaccgccggctgggacacccgggtgaccgaggacgacctgcagaacgaggccaagatcacggacatcatggagcccgagcacgccctcctggcgacctccatcttcaagctgacctaccagaacaaggtggtccgcgtgcagcggcccgccaagaacgggaccgtgatggacgtcatcagccgccgggaccagcgcggctccggccaggtggggacgtacggcctcaacaccttcaccaacatggaggtgcagctgatccggcagatggagagcgaggggatcttcctgccctccgagctcgagaccccgaacctggccgagcgcgccctggactggctcgagaagcacggcgccgagcggctgaagcgcatggcgatcagcggggacgactgcgtcgtgaagcccatcgacgaccggttcgccacggccctgaccgccctcaacgacatgggcaaggtgcgcaaggacatcccccagtgggagccctccaagggctggaacgactggcagcaggtcccgttctgcagccaccacttccaccagctgatcatgaaggacgggcgggagatcgtggtgccctgccgcaaccaggacgagctggtcggccgggcccgcgtgtcccagggggcgggctggagcctccgggagaccgcctgcctggggaagtcctacgcccagatgtggcagctgatgtacttccaccgccgggacctccgcctggccgcgaacgccatctgcagcgccgtgcccgtcgactgggtgcccaccagccgcaccacgtggtccatccacgcccaccaccagtggatgaccaccgaggacatgctgagcgtgtggaaccgggtctggatcgaggagaacccgtggatggagaacaagacccacgtgtccagctgggaggaggtgccctacctcggcaagcgcgaggaccagtggtgcggctccctgatcgggctgacggcccgggcgacctgggccaccaacatccaggtcgccatcaaccaggtgcgccggctcatcggcaacgagaactacctggactacatgaccagcatgaagcgcttcaagaacgagtccgacagcgagggggccctgtggtga

SEQ ID NO: 8182 - RNA, 9879 nt, synthetic construct
  misc_feature 1..9879: note = derived and/or modified CDS sequence (opt1) from DENV-1__KJ189353__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctcgtccaccagatcttcggcaccgcctacggggtgctgttcagcggcgtgtcctggaccatgaagatcgggatcggcatcctgctcacgtggctgggcctgaacagccggtccaccagcctctccatgacctgcatcgccgtcgggatggtgaccctgtacctgggcgtgatggtccaggccgacagcgggtgcgtgatcaactggaagggccgcgagctcaagtgcgggtccggcatcttcgtgacgaacgaggtccacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtggtcgtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtggaggactacgggttcggcgtcttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtgaagacctgcacgtggcccaagagccacaccctgtggtccaacggggtcctcgagagcgagatgatcatccccaagatctacggcgggccgatctcccagcacaactaccggcccggctacttcacccagaccgccgggccctggcacctgggcaagctggagctcgacttcgagctgtgcgagggcacgaccgtggtggtcgacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtgaaggagaaggaggagaacctggtccgcagcatggtgtccgccggcagcggggaggtggacagcttctccctcggcatcctgtgcgtcagcatcatgatcgaggaggtgatgcggtcccgctggagccgcaagatgctgatgaccgggacgctcgccgtgttcctgctgctcatcatgggccagctgacctggaacgacctgatccggctctgcatcatggtcggggccaacgcgtccgaccgcatgggcatgggcaccacctacctggccctgatggccacgttcaagatgcggccgatgttcgccgtggggctcctgttccgccggctgaccagccgcgaggtgctcctgctgaccatcggcctctccctggtcgccagcgtggagctgcccaactccctcgaggagctgggggacggcctggcgatgggcatcatgatgctcaagctgctgaccgagttccagccccaccagctctggacgaccctgctgagcctcaccttcgtcaagaccacgctgtccctggactacgcctggaagaccaccgccatggccctcagcatcgtgtccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggcgatcgggatcgtcagcatcctgctgtccagcctcctgaagaacgacgtgcccctggccggcccgctcatcgccggcgggatgctgatcgcctgctacgtgatcagcggctccagcgccgacctgtccctcgagaaggcggccgaggtcagctgggagcaggaggccgagcactccggggccagccactccatcctggtggaggtgcaggacgacggcacgatgaagatcaaggacgaggagcgcgacgacaccctgaccatcctcctgaaggccaccctgctcgcggtcagcggggtgtaccccatgtccatccccgccacgctgttcgtgtggtacttctggcagaagaagaagcagcggagcggcgtcctgtgggacaccccctccccgcccgaggtggagcgcgccgtgctcgacaacggcatctaccggatcctgcagcgcgggctgctgggccggagccaggtcggggtgggcgtgttccaggacggggtcttccacaccatgtggcacgtgacccgcggcgccgtgctcatgtaccagggcaagcggctggagccctcctgggccagcgtcaagaaggacctgatctcctacgggggcgggtggcgcttccagggcagctggaacacgggggaggaggtccaggtgatcgcggtcgagcccggcaagaacccgaagaacgtgcagaccacccccggcaccttcaagacgcccgagggggaggtgggcgccatcgccctcgacttcaagcccgggacctccggcagcccgatcgtcaaccgggagggcaagatcgtggggctgtacggcaacggggtggtcaccacctccggcacgtacgtgagcgccatcgcccaggcgaaggccagccaggaggggcccctgcccgagatcgaggacgaggtgttcaagaagcgcaacctcaccatcatggacctgcacccgggctccggcaagacccggcgctacctgcccgccatcgtccgggaggccatcaagcgcaagctccgcaccctgatcctggcgcccacgcgggtggtggccagcgagatggccgaggccctcaaggggatgcccatccgctaccagaccaccgccgtcaagtccgagcacaccggccgggagatcgtggacctgatgtgccacgcgacgttcaccatgcgcctgctcagcccggtgcgggtccccaactacaacatgatcatcatggacgaggcccacttcaccgaccccgcctccatcgccgcccgcgggtacatcagcacccgggtgggcatgggggaggcggccgccatcttcatgacggccacgccgcccggctccgtggaggccttcccccagagcaacgcggtcatccaggacgaggagcgcgacatccccgagcggtcctggaacagcggctacgactggatcaccgacttccccgggaagaccgtgtggttcgtgccctccatcaagagcggcaacgacatcgccaactgcctgcgcaagaacgggaagcgggtcatccagctgtcccgcaagacgttcgacaccgagtaccagaagaccaagaacaacgactgggactacgtggtgaccacggacatcagcgagatgggcgccaacttccgggccgaccgcgtcatcgacccccggcgctgcctcaagcccgtgatcctgaaggacgggcccgagcgggtgatcctggcgggcccgatgcccgtcaccgccgcctccgccgcccagcgccggggccgcatcgggcgcaaccagaacaaggagggcgaccagtacgtgtacatggggcagcccctcaacaacgacgaggaccacgcgcactggaccgaggccaagatgctgctggacaacatcaacacccccgagggcatcatcccggccctcttcgagcccgagcgggagaagtccgccgccatcgacggggagtaccgcctgcggggcgaggcgcgcaagacgttcgtcgagctgatgcggcgcggcgacctccccgtgtggctgtcctacaaggtggccagcgaggggttccagtactccgaccggcgctggtgcttcgacggcgagcggaacaaccaggtcctggaggagaacatggacgtggagatctggaccaaggagggggagcgcaagaagctccggccccgctggctggacgcccggacctacagcgacccgctggccctccgcgagttcaaggagttcgccgcgggccggcgcagcgtgtccggcgacctgatcctggagatcgggaagctcccccagcacctgaccctgcgggcccagaacgccctcgacaacctggtcatgctgcacaacagcgagcagggcgggaaggcctaccgccacgcgatggaggagctccccgacaccatcgagacgctgatgctgctcgccctgatcgccgtgctgaccggcggggtgaccctcttcttcctgtccggcaagggcctggggaagaccagcatcggcctcctgtgcgtcacggcctccagcgccctgctctggatggcgtccgtggagccccactggatcgccgccagcatcatcctggagttcttcctgatggtgctcctgatcccggagcccgaccggcagcgcacgccccaggacaaccagctggcctacgtcgtgatcgggctcctgttcatgatcctgaccgtggccgcgaacgagatgggcctcctggagaccacgaagaaggacctggggatcggctacgtcgccgccgagaaccaccagcacgccaccatgctcgacgtggacctgcacccggcctccgcgtggaccctgtacgccgtggccaccacggtcatcacccccatgatgcggcacaccatcgagaacaccacggccaacatcagcctcaccgccatcgcgaaccaggccgccatcctgatgggcctggacaaggggtggcccatctccaagatggacatcggcgtgcccctcctggccctggggtgctacagccaggtgaacccgctcaccctgaccgcggccgtcctgatgctcgtggcccactacgccatcatcggccccgggctgcaggccaaggcgacgcgcgaggcccagaagcgcaccgccgccggcatcatgaagaaccccaccgtggacggcatcgtcgccatcgacctggaccccgtggtgtacgacgcgaagttcgagaagcagctcgggcagatcatgctgctgatcctctgcacctcccagatcctgctgatgcggacgacctgggccctctgcgagagcatcaccctggccaccggcccgctgacgaccctctgggaggggtcccccggcaagttctggaacaccaccatcgccgtcagcatggccaacatcttccgcggctcctacctggcgggggccggcctggccttcagcctcatgaagtccctcgggggcgggcggcgcggcacgggcgcccagggggagaccctgggcgagaagtggaagcggcagctcaaccagctgagcaagagcgagttcaacacctacaagcgctccgggatcatggaggtggaccggagcgaggcgaaggagggcctgaagcgcggggagaccacgaagcacgccgtgtcccggggcaccgccaagctccgctggttcgtcgagcggaacctggtgaagcccgagggcaaggtgatcgacctggggtgcggccgcgggggctggagctactactgcgccgggctgaagaaggtcaccgaggtgaagggctacaccaagggcgggcccggccacgaggagccgatccccatggccacctacgggtggaacctcgtgaagctgcactccggcaaggacgtcttcttcatgccgcccgagaagtgcgacacgctgctctgcgacatcggggagagctccccgaaccccaccatcgaggagggccggaccctgcgcgtgctgaagatggtggagccctggctccggggcaaccagttctgcatcaagatcctgaacccctacatgccgagcgtcgtggagaccctggagcgcatgcagcggaagcacgggggcatgctcgtgcgcaaccccctgtcccggaacagcacgcacgagatgtactgggtctcctgcgggaccggcaacatcgtgagcgcggtgaacatgacctcccgcatgctgctcaaccgcttcaccatggcccaccggaagcccacgtacgagcgcgacgtcgacctgggcgccgggacccggcacgtggccgtggagcccgaggtcgccaacctggacatcatcggccagcgcatcgagaacatcaagaacgagcacaagagcacctggcactacgacgaggacaacccgtacaagacctgggcgtaccacgggtcctacgaggtgaagcccagcggctccgccagctccatggtgaacggggtcgtgcggctcctgacgaagccctgggacgtcatccccatggtgacccagatcgccatgaccgacaccacgccgttcggccagcagcgcgtgttcaaggagaaggtcgacacccggacgccccgcgccaagcggggcaccacgcagatcatggaggtgaccgccaagtggctgtgggggttcctcagccgcaacaagaagccccggatctgcacccgcgaggagttcacccggaaggtgcgcagcaacgcggccatcggcgccgtcttcgtggacgagaaccagtggaactccgccaaggaggcggtggaggacgagcggttctgggacctggtccaccgcgagcgggagctgcacaagcaggggaagtgcgccacgtgcgtgtacaacatgatgggcaagcgcgagaagaagctcggggagttcggcaaggccaagggcagccgggccatctggtacatgtggctgggggcccgcttcctggagttcgaggcgctcggcttcatgaacgaggaccactggttctcccgggagaacagcctgtccggggtggagggcgaggggctgcacaagctcggctacatcctgcgcgacatcagcaagatcccgggcgggaacatgtacgccgacgacaccgccggctgggacacccgcgtcaccgaggacgacctgcagaacgaggccaagatcacggacatcatggagcccgagcacgccctcctggcgacctccatcttcaagctgacctaccagaacaaggtggtgcgggtccagcgccccgccaagaacgggaccgtgatggacgtgatcagccggcgcgaccagcggggctccggccaggtcgggacgtacggcctcaacaccttcaccaacatggaggtgcagctgatccgccagatggagagcgaggggatcttcctgccctccgagctcgagaccccgaacctggccgagcgggccctggactggctcgagaagcacggcgccgagcgcctgaagcggatggcgatcagcggggacgactgcgtggtcaagcccatcgacgaccgcttcgccacggccctgaccgccctcaacgacatgggcaaggtgcggaaggacatcccccagtgggagccctccaagggctggaacgactggcagcaggtcccgttctgcagccaccacttccaccagctgatcatgaaggacgggcgcgagatcgtcgtgccctgccggaaccaggacgagctggtgggccgcgcccgggtctcccagggggcgggctggagcctccgcgagaccgcctgcctggggaagtcctacgcccagatgtggcagctgatgtacttccaccggcgcgacctccggctggccgcgaacgccatctgcagcgccgtgcccgtggactgggtccccaccagccgcaccacgtggtccatccacgcccaccaccagtggatgaccaccgaggacatgctgagcgtgtggaaccgcgtgtggatcgaggagaacccgtggatggagaacaagacccacgtctccagctgggaggaggtgccctacctcggcaagcgggaggaccagtggtgcggctccctgatcgggctgacggcccgcgcgacctgggccaccaacatccaggtggccatcaaccaggtccggcgcctcatcggcaacgagaactacctggactacatgaccagcatgaagcggttcaagaacgagtccgacagcgagggggccctgtggtga

SEQ ID NO: 8183 - RNA, 9879 nt, synthetic construct
  misc_feature 1..9879: note = derived and/or modified CDS sequence (opt1) from DENV-1__KJ189354__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctcgtccaccagatcttcggcaccgcctacggggtgctgttcagcggcgtgtcctggaccatgaagatcgggatcggcatcctgctcacgtggctgggcctgaacagccggtccaccagcctctccatgacctgcatcgccgtcgggatggtgaccctgtacctgggcgtgatggtccaggccgacagcgggtgcgtgatcaactggaagggccgcgagctcaagtgcgggtccggcatcttcgtgacgaacgaggtccacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtggtcgtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtggaggactacgggttcggcgtcttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtgaagacctgcacgtggcccaagagccacaccctgtggtccaacggggtcctcgagagcgagatgatcatccccaagatctacggcgggccgatctcccagcacaactaccggcccggctacttcacccagaccgccgggccctggcacctgggcaagctggagctcgacttcgacctgtgcgagggcacgaccgtggtggtcgacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtgaaggagaaggaggagaacctggtccgcagcatggtgtccgccggcagcggggaggtggacagcttctccctcggcatcctgtgcgtcagcatcatgatcgaggaggtgatgcggtcccgctggagccgcaagatgctgatgaccgggacgctcgccgtgttcctgctgctcatcatgggccagctgacctggaacgacctgatccggctctgcatcatggtcggggccaacgcgtccgaccgcatgggcatgggcaccacctacctggccctgatggccacgttcaagatgcggccgatgttcgccgtggggctcctgttccgccggctgaccagccgcgaggtgctcctgctgaccatcggcctctccctggtcgccagcgtggagctgcccaactccctcgaggagctgggggacggcctggcgatgggcatcatgatgctcaagctgctgaccgagttccagccccaccagctctggacgaccctgctgagcctcaccttcgtcaagaccacgctgtccctggactacgcctggaagaccaccgccatggccctcagcatcgtgtccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggcgatcgggatcgtcagcatcctgctgtccagcctcctgaagaacgacgtgcccctggccggcccgctcatcgccggcgggatgctgatcgcctgctacgtgatcagcggctccagcgccgacctgtccctcgagaaggcggccgaggtcagctgggagcaggaggccgagcactccggggccagccactccatcctggtggaggtgcaggacgacggcacgatgaagatcaaggacgaggagcgcgacgacaccctgaccatcctcctgaaggccaccctgctcgcggtcagcggggtgtaccccatgtccatccccgccacgctgttcgtgtggtacttctggcagaagaagaagcagcggagcggcgtcctgtgggacaccccctccccgcccgaggtggagcgcgccgtgctcgacaacggcatctaccggatcctgcagcgcgggctgctgggccggagccaggtcggggtgggcgtgttccaggacggggtcttccacaccatgtggcacgtgacccgcggcgccgtgctcatgtaccagggcaagcggctggagccctcctgggccagcgtcaagaaggacctgatctcctacgggggcgggtggcgcttccagggcagctggaacacgggggaggaggtccaggtgatcgcggtcgagcccggcaagaacccgaagaacgtgcagaccacccccggcaccttcaagacgcccgagggggaggtgggcgccatcgccctcgacttcaagcccgggacctccggcagcccgatcgtcaaccgggagggcaagatcgtggggctgtacggcaacggggtggtcaccacctccggcacgtacgtgagcgccatcgcccaggcgaaggccagccaggaggggcccctgcccgagatcgaggacgaggtgttcaagaagcgcaacctcaccatcatggacctgcacccgggctccggcaagacccggcgctacctgcccgccatcgtccgggaggccatcaagcgcaagctccgcaccctgatcctggcgcccacgcgggtggtggccagcgagatggccgaggccctcaaggggatgcccatccgctaccagaccaccgccgtcaagtccgagcacaccggccgggagatcgtggacctgatgtgccacgcgacgttcaccatgcgcctgctcagcccggtgcgggtccccaactacaacatgatcatcatggacgaggcccacttcaccgaccccgcctccatcgccgcccgcgggtacatcagcacccgggtgggcatgggggaggcggccgccatcttcatgacggccacgccgcccggctccgtggaggccttcccccagagcaacgcggtcatccaggacgaggagcgcgacatccccgagcggtcctggaacagcggctacgactggatcaccgacttccccgggaagaccgtgtggttcgtgccctccatcaagagcggcaacgacatcgccaactgcctgcgcaagaacgggaagcgggtcatccagctgtcccgcaagacgttcgacaccgagtaccagaagaccaagaacaacgactgggactacgtggtgaccacggacatcagcgagatgggcgccaacttccgggccgaccgcgtcatcgacccccggcgctgcctcaagcccgtgatcctgaaggacgggcccgagcgggtgatcctggcgggcccgatgcccgtcaccgccgcctccgccgcccagcgccggggccgcatcgggcgcaaccagaacaaggagggcgaccagtacgtgtacatggggcagcccctcaacaacgacgaggaccacgcgcactggaccgaggccaagatgctgctggacaacatcaacacccccgagggcatcatcccggccctcttcgagcccgagcgggagaagtccgccgccatcgacggggagtaccgcctgcggggcgaggcgcgcaagacgttcgtcgagctgatgcggcgcggcgacctccccgtgtggctgtcctacaaggtggccagcgaggggttccagtactccgaccggcgctggtgcttcgacggcgagcggaacaaccaggtcctggaggagaacatggacgtggagatctggaccaaggagggggagcgcaagaagctccggccccgctggctggacgcccggacctacagcgacccgctggccctccgcgagttcaaggagttcgccgcgggccggcgcagcgtgtccggcgacctgatcctggagatcgggaagctcccccagcacctgaccctgcgggcccagaacgccctcgacaacctggtcatgctgcacaacagcgagcagggcgggaaggcctaccgccacgcgatggaggagctccccgacaccatcgagacgctgatgctgctcgccctgatcgccgtgctgaccggcggggtgaccctcttcttcctgtccggcaagggcctggggaagaccagcatcggcctcctgtgcgtcacggcctccagcgccctgctctggatggcgtccgtggagccccactggatcgccgccagcatcatcctggagttcttcctgatggtgctcctgatcccggagcccgaccggcagcgcacgccccaggacaaccagctggcctacgtcgtgatcgggctcctgttcatgatcctgaccgtggccgcgaacgagatgggcctcctggagaccacgaagaaggacctggggatcggctacgtcgccgccgagaaccaccagcacgccaccatgctcgacgtggacctgcacccggcctccgcgtggaccctgtacgccgtggccaccacggtcatcacccccatgatgcggcacaccatcgagaacaccacggccaacatcagcctcaccgccatcgcgaaccaggccgccatcctgatgggcctggacaaggggtggcccatctccaagatggacatcggcgtgcccctcctggccctggggtgctacagccaggtgaacccgctcaccctgaccgcggccgtcctgatgctcgtggcccactacgccatcatcggccccgggctgcaggccaaggcgacgcgcgaggcccagaagcgcaccgccgccggcatcatgaagaaccccaccgtggacggcatcgtcgccatcgacctggaccccgtggtgtacgacgcgaagttcgagaagcagctcgggcagatcatgctgctgatcctctgcacctcccagatcctgctgatgcggacgacctgggccctctgcgagagcatcaccctggccaccggcccgctgacgaccctctgggaggggtcccccggcaagttctggaacaccaccatcgccgtcagcatggccaacatcttccgcggctcctacctggcgggggccggcctggccttcagcctcatgaagtccctcgggggcgggcggcgcggcacgggcgcccagggggagaccctgggcgagaagtggaagcggcagctcaaccagctgagcaagagcgagttcaacacctacaagcgctccgggatcatggaggtggaccggagcgaggcgaaggagggcctgaagcgcggggagaccacgaagcacgccgtgtcccggggcaccgccaagctccgctggttcgtcgagcggaacctggtgaagcccgagggcaaggtgatcgacctggggtgcggccgcgggggctggagctactactgcgccgggctgaagaaggtcaccgaggtgaagggctacaccaagggcgggcccggccacgaggagccgatccccatggccacctacgggtggaacctcgtgaagctgcactccggcaaggacgtcttcttcatgccgcccgagaagtgcgacacgctgctctgcgacatcggggagagctccccgaaccccaccatcgaggagggccggaccctgcgcgtgctgaagatggtggagccctggctccggggcaaccagttctgcatcaagatcctgaacccctacatgccgagcgtcgtggagaccctggagcgcatgcagcggaagcacgggggcatgctcgtgcgcaaccccctgtcccggaacagcacgcacgagatgtactgggtctcctgcgggaccggcaacatcgtgagcgcggtgaacatgacctcccgcatgctgctcaaccgcttcaccatggcccaccggaagcccacgtacgagcgcgacgtcgacctgggcgccgggacccggcacgtggccgtggagcccgaggtcgccaacctggacatcatcggccagcgcatcgagaacatcaagaacgagcacaagagcacctggcactacgacgaggacaacccgtacaagacctgggcgtaccacgggtcctacgaggtgaagcccagcggctccgccagctccatggtgaacggggtcgtgcggctcctgacgaagccctgggacgtcatccccatggtgacccagatcgccatgaccgacaccacgccgttcggccagcagcgcgtgttcaaggagaaggtcgacacccggacgccccgcgccaagcggggcaccacgcagatcatggaggtgaccgccaagtggctgtgggggttcctcagccgcaacaagaagccccggatctgcacccgcgaggagttcacccggaaggtgcgcagcaacgcggccatcggcgccgtcttcgtggacgagaaccagtggaactccgccaaggaggcggtggaggacgagaagttctgggacctggtccaccgggagcgcgagctgcacaagcaggggaagtgcgccacgtgcgtgtacaacatgatgggcaagcgggagaagaagctcggggagttcggcaaggccaagggcagccgcgccatctggtacatgtggctgggggcccggttcctggagttcgaggcgctcggcttcatgaacgaggaccactggttctcccgcgagaacagcctgtccggggtggagggcgaggggctgcacaagctcggctacatcctgcgggacatcagcaagatcccgggcgggaacatgtacgccgacgacaccgccggctgggacacccgcgtcaccgaggacgacctgcagaacgaggccaagatcacggacatcatggagcccgagcacgccctcctggcgacctccatcttcaagctgacctaccagaacaaggtggtgcgcgtccagcggcccgccaagaacgggaccgtgatggacgtgatcagccgccgggaccagcgcggctccggccaggtcgggacgtacggcctcaacaccttcaccaacatggaggtgcagctgatccggcagatggagagcgaggggatcttcctgccctccgagctcgagaccccgaacctggccgagcgcgccctggactggctcgagaagcacggcgccgagcggctgaagcgcatggcgatcagcggggacgactgcgtggtcaagcccatcgacgaccggttcgccacggccctgaccgccctcaacgacatgggcaaggtgcgcaaggacatcccccagtgggagccctccaagggctggaacgactggcagcaggtcccgttctgcagccaccacttccaccagctgatcatgaaggacgggcgggagatcgtcgtgccctgccgcaaccaggacgagctggtgggccgggcccgcgtctcccagggggcgggctggagcctccgggagaccgcctgcctggggaagtcctacgcccagatgtggcagctgatgtacttccaccgccgggacctccgcctggccgcgaacgccatctgcagcgccgtgcccgtggactgggtccccaccagccggaccacgtggtccatccacgcccaccaccagtggatgaccaccgaggacatgctgagcgtgtggaaccgcgtgtggatcgaggagaacccgtggatggagaacaagacccacgtctccagctgggaggaggtgccctacctcggcaagcgcgaggaccagtggtgcggctccctgatcgggctgacggcccgggcgacctgggccaccaacatccaggtggccatcaaccaggtccgccggctcatcggcaacgagaactacctggactacatgaccagcatgaagcgcttcaagaacgagtccgacagcgagggggccctgtggtga

SEQ ID NO: 8184 - RNA, 9879 nt, synthetic construct
  misc_feature 1..9879: note = derived and/or modified CDS sequence (opt1) from DENV-1__KJ189355__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgagaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcatcgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacaccgcgtgggacttcgggagcatcggcggcgtgttcacgtccgtggggaagctcgtccaccagatcttcggcaccgcctacggggtgctgttcagcggcgtgtcctggaccatgaagatcgggatcggcatcctgctcacctggctgggcctgaacagccggtccatgagcctctccatgacgtgcatcgccgtcgggatggtgaccctgtacctgggcgtgatggtccaggccgacagcgggtgcgtgatcaactggaagggccgcgagctcaagtgcgggtccggcatcttcgtgaccaacgaggtccacacctggacggagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtggtcgtgggggacgccaacggcatcctcgcgcaggggaagaagatgatccgcccccagcccatggagcacaagtactcctggaagtcctggggcaaggccaagatcatcggcgccgacatccagaacaccaccttcatcatcgacgggcccgacacgccggagtgccccgacggccagcgggcctggaacatctgggaggtggaggactacgggttcggcgtcttcaccaccaacatctggctgaagctgcgcgactcctacacccagatgtgcgaccaccggctcatgagcgcggccatcaaggactccaaggccgtgcacgccgacatgggctactggatcgagagcgagaagaacgagacgtggaagctggcccgcgcgtccttcatcgaggtgaagacctgcacctggcccaagagccacaccctgtggtccaacggggtcctcgagagcgagatgatcatccccaagatctacggcgggccgatctcccagcacaactaccggcccggctacttcacgcagaccgccgggccctggcacctgggcaagctggagctcgacttcgacctgtgcgagggcaccaccgtggtggtcgacgagcactgcgggaaccgcggcccgagcctgcggacgaccaccgtgaccgggaagatcatccacgagtggtgctgccgctcctgcacgctgccgcccctgcggttccgcggcgaggacgggtgctggtacggcatggagatccggcccgtgaaggagaaggaggagaacctggtccgcagcatggtgtccgccggcagcggggaggtggacagcttctccctcggcatcctgtgcgtcagcatcatgatcgaggaggtgatgcggtcccgctggagccgcaagatgctgatgaccgggaccctcgccgtgttcctgctgctcatcatgggccagctgacctggaacgacctgatccggctctgcatcatggtcggggccaacgcgtccgaccgcatgggcatgggcacgacctacctggccctgatggccaccttcaagatgcggccgatgttcgccgtggggctcctgttccgccggctgaccagccgcgaggtgctcctgctgacgatcggcctctccctggtcgccagcgtggagctgcccaactccctcgaggagctgggggacggcctggcgatgggcatcatgatgctcaagctgctgaccgagttccagccccaccagctctggaccaccctgctgagcctcacgttcgtcaagaccaccctgtccctggactacgcctggaagaccacggccatggccctcagcatcgtgtccctgttccccctgtgcctcagcaccacctcccagaagaccacgtggctgccggtgctgctcgggagcttcggctgcaagcccctgaccatgttcctgatcaccgagaacaagatctgggggcggaagtcctggcccctcaacgagggcatcatggcgatcgggatcgtcagcatcctgctgtccagcctcctgaagaacgacgtgcccctggccggcccgctcatcgccggcgggatgctgatcgcctgctacgtgatcagcggctccagcgccgacctgtccctcgagaaggcggccgaggtcagctgggagcaggaggccgagcactccggggccagccactccatcctggtggaggtgcaggacgacggcaccatgaagatcaaggacgaggagcgcgacgacaccctgacgatcctcctgaaggccaccctgctcgcggtcagcggggtgtaccccatgtccatccccgccaccctgttcgtgtggtacttctggcagaagaagaagcagcggagcggcgtcctgtgggacaccccctccccgcccgaggtggagcgcgccgtgctcgacaacggcatctaccggatcctgcagcgcgggctgctgggccggagccaggtcggggtgggcgtgttccaggacggggtcttccacacgatgtggcacgtgacccgcggcgccgtgctcatgtaccagggcaagcggctggagccctcctgggccagcgtcaagaaggacctgatctcctacgggggcgggtggcgcttccagggcagctggaacaccggggaggaggtccaggtgatcgcggtcgagcccggcaagaacccgaagaacgtgcagaccacgcccggcaccttcaagacccccgagggggaggtgggcgccatcgccctcgacttcaagcccgggacctccggcagcccgatcgtcaaccgggagggcaagatcgtggggctgtacggcaacggggtggtcacgacctccggcacctacgtgagcgccatcgcccaggcgaaggccagccaggaggggcccctgcccgagatcgaggacgaggtgttcaagaagcgcaacctcaccatcatggacctgcacccgggctccggcaagacgcggcgctacctgcccgccatcgtccgggaggccatcaagcgcaagctccgcaccctgatcctggcgcccacccgggtggtggccagcgagatggccgaggccctcaaggggatgcccatccgctaccagaccacggccgtcaagtccgagcacaccggccgggagatcgtggacctgatgtgccacgcgaccttcaccatgcgcctgctcagcccggtgcgggtccccaactacaacatgatcatcatggacgaggcccacttcacggaccccgcctccatcgccgcccgcgggtacatcagcacccgggtgggcatgggggaggcggccgccatcttcatgaccgccacgccgcccggctccgtggaggccttcccccagagcaacgcggtcatccaggacgaggagcgcgacatccccgagcggtcctggaacagcggctacgactggatcacggacttccccgggaagaccgtgtggttcgtgccctccatcaagagcggcaacgacatcgccaactgcctgcgcaagaacgggaagcgggtcatccagctgtcccgcaagaccttcgacaccgagtaccagaagacgaagaacaacgactgggactacgtggtgaccaccgacatcagcgagatgggcgccaacttccgggccgaccgcgtcatcgacccccggcgctgcctcaagcccgtgatcctgaaggacgggcccgagcgggtgatcctggcgggcccgatgcccgtcaccgccgcctccgccgcccagcgccggggccgcatcgggcgcaaccagaacaaggagggcgaccagtacgtgtacatggggcagcccctcaacaacgacgaggaccacgcgcactggacggaggccaagatgctgctggacaacatcaacacccccgagggcatcatcccggccctcttcgagcccgagcgggagaagtccgccgccatcgacggggagtaccgcctgcggggcgaggcgcgcaagaccttcgtcgagctgatgcggcgcggcgacctccccgtgtggctgtcctacaaggtggccagcgaggggttccagtactccgaccggcgctggtgcttcgacggcgagcggaacaaccaggtcctggaggagaacatggacgtggagatctggaccaaggagggggagcgcaagaagctccggccccgctggctggacgcccggacgtacagcgacccgctggccctccgcgagttcaaggagttcgccgcgggccggcgcagcgtgtccggcgacctgatcctggagatcgggaagctcccccagcacctgaccctgcgggcccagaacgccctcgacaacctggtcatgctgcacaacagcgagcagggcgggaaggcctaccgccacgcgatggaggagctccccgacaccatcgagaccctgatgctgctcgccctgatcgccgtgctgaccggcggggtgaccctcttcttcctgtccggcaagggcctggggaagaccagcatcggcctcctgtgcgtcaccgcctccagcgccctgctctggatggcgtccgtggagccccactggatcgccgccagcatcatcctggagttcttcctgatggtgctcctgatcccggagcccgaccggcagcgcacgccccaggacaaccagctggcctacgtcgtgatcgggctcctgttcatgatcctgacggtggccgcgaacgagatgggcctcctggagaccaccaagaaggacctggggatcggctacgtcgccgccgagaaccaccagcacgccaccatgctcgacgtggacctgcacccggcctccgcgtggacgctgtacgccgtggccaccaccgtcatcacccccatgatgcggcacacgatcgagaacaccaccgccaacatcagcctcaccgccatcgcgaaccaggccgccatcctgatgggcctggacaaggggtggcccatctccaagatggacatcggcgtgcccctcctggccctggggtgctacagccaggtgaacccgctcacgctgaccgcggccgtcctgatgctcgtggcccactacgccatcatcggccccgggctgcaggccaaggcgacccgcgaggcccagaagcgcaccgccgccggcatcatgaagaaccccacggtggacggcatcgtcgccatcgacctggaccccgtggtgtacgacgcgaagttcgagaagcagctcgggcagatcatgctgctgatcctctgcacctcccagatcctgctgatgcggaccacctgggccctctgcgagagcatcacgctggccaccggcccgctgaccaccctctgggaggggtcccccggcaagttctggaacacgaccatcgccgtcagcatggccaacatcttccgcggctcctacctggcgggggccggcctggccttcagcctcatgaagtccctcgggggcgggcggcgcggcaccggcgcccagggggagaccctgggcgagaagtggaagcggcagctcaaccagctgagcaagagcgagttcaacacgtacaagcgctccgggatcatggaggtggaccggagcgaggcgaaggagggcctgaagcgcggggagaccaccaagcacgccgtgtcccggggcaccgccaagctccgctggttcgtcgagcggaacctggtgaagcccgagggcaaggtgatcgacctggggtgcggccgcgggggctggagctactactgcgccgggctgaagaaggtcacggaggtgaagggctacaccaagggcgggcccggccacgaggagccgatccccatggccacctacgggtggaacctcgtgaagctgcactccggcaaggacgtcttcttcatgccgcccgagaagtgcgacaccctgctctgcgacatcggggagagctccccgaaccccaccatcgaggagggccggacgctgcgcgtgctgaagatggtggagccctggctccggggcaaccagttctgcatcaagatcctgaacccctacatgccgagcgtcgtggagaccctggagcgcatgcagcggaagcacgggggcatgctcgtgcgcaaccccctgtcccggaacagcacccacgagatgtactgggtctcctgcgggaccggcaacatcgtgagcgcggtgaacatgacgtcccgcatgctgctcaaccgcttcaccatggcccaccggaagcccacctacgagcgcgacgtcgacctgggcgccgggacccggcacgtggccgtggagcccgaggtcgccaacctggacatcatcggccagcgcatcgagaacatcaagaacgagcacaagagcacgtggcactacgacgaggacaacccgtacaagacctgggcgtaccacgggtcctacgaggtgaagcccagcggctccgccagctccatggtgaacggggtcgtgcggctcctgaccaagccctgggacgtcatccccatggtgacccagatcgccatgacggacaccaccccgttcggccagcagcgcgtgttcaaggagaaggtcgacacccggacgccccgcgccaagcggggcaccacccagatcatggaggtgaccgccaagtggctgtgggggttcctcagccgcaacaagaagccccggatctgcacgcgcgaggagttcacccggaaggtgcgcagcaacgcggccatcggcgccgtcttcgtggacgagaaccagtggaactccgccaaggaggcggtggaggacgagcggttctgggacctggtccaccgcgagcgggagctgcacaagcaggggaagtgcgcgacctgcgtgtacaacatgatgggcaagcgcgagaagaagctcggggagttcggcaaggccaagggcagccgggccatctggtacatgtggctgggggcccgcttcctggagttcgaggcgctcggcttcatgaacgaggaccactggttctcccgggagaacagcctgtccggggtggagggcgaggggctgcacaagctcggctacatcctgcgcgacatcagcaagatcccgggcgggaacatgtacgccgacgacaccgccggctgggacacgcgcgtcaccgaggacgacctgcagaacgaggccaagatcaccgacatcatggagcccgagcacgccctcctggcgacctccatcttcaagctgacgtaccagaacaaggtggtgcgggtccagcgccccgccaagaacgggaccgtgatggacgtgatcagccggcgcgaccagcggggctccggccaggtcgggacctacggcctcaacaccttcacgaacatggaggtgcagctgatccgccagatggagagcgaggggatcttcctgccctccgagctcgagaccccgaacctggccgagcgggccctgggctggctcgagaagcacggggccgagcgcctgaagcggatggcgatcagcggcgacgactgcgtggtcaagcccatcgacgaccgcttcgccaccgccctgaccgccctcaacgacatgggcaaggtgcggaaggacatcccccagtgggagccctccaaggggtggaacgactggcagcaggtcccgttctgcagccaccacttccaccagctgatcatgaaggacggccgcgagatcgtcgtgccctgccggaaccaggacgagctggtggggcgcgcccgggtctcccagggcgcggggtggagcctccgcgagacggcctgcctgggcaagtcctacgcccagatgtggcagctgatgtacttccaccggcgcgacctccggctggccgcgaacgccatctgcagcgccgtgcccgtggactgggtccccaccagccgcaccacctggtccatccacgcccaccaccagtggatgaccacggaggacatgctgagcgtgtggaaccgcgtgtggatcgaggagaacccgtggatggagaacaagacccacgtctccagctgggaggaggtgccctacctcggcaagcgggaggaccagtggtgcgggtccctgatcggcctgaccgcccgcgcgacctgggccacgaacatccaggtggccatcaaccaggtccggcgcctcatcgggaacgagaactacctggactacatgaccagcatgaagcggttcaagaacgagtccgacagcgagggcgccctgtggtga

SEQ ID NO: 8185 - RNA, 9879 nt, synthetic construct
  misc_feature 1..9879: note = derived and/or modified CDS sequence (opt1) from DENV-1__KJ189358__SS-prME
  source 1..9879: mol_type = other RNA
agcgtgaccatgctgctcatgctgctgcccaccgtgctcgccttccacctgaccacccgcggcggggagccccacatgatcgtgagcaagcaggagcggggcaagagcctcctgttcaagaccagcgccggggtgaacatgtgcaccctgatcgcgatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtcggcctggggctcgagacccgcaccgagacctggatgagctccgagggcgcctggaagcagatccagcgggtggagacctgggccctgcgccaccccgggttcacggtgatcgccttcttcctggcccacgcgatcggcaccagcatcacccagaaggggatcatcttcatcctcctgatgctggtcaccccctccatggccatgcggtgcgtgggcatcggcaaccgcgacttcgtggaggggctcagcggcgccacgtgggtcgacgtggtgctggagcacgggtcctgcgtcaccaccatggccaagaacaagcccaccctggacatcgagctcctgaagacggaggtgaccaaccccgccgtgctgcggaagctctgcatcgaggcgaagatcagcaacaccaccacggactcccgctgcccgacccagggcgaggccaccctggtcgaggagcaggacgccaacttcgtgtgccggcgcaccttcgtggaccggggctgggggaacggctgcgggctgttcggcaaggggagcctcctgacgtgcgccaagttcaagtgcgtcaccaagctggagggcaagatcgtgcagtacgagaacctcaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctgaccctcgactgcagcccccggaccggcctggacttcaacgagatggtgctgctcacgatgaaggagaagtcctggctggtgcacaagcagtggttcctggacctcccgctgccctggacctccggggccagcaccagccaggagacctggaaccggcaggacctgctcgtcacgttcaagaccgcccacgccaagaagcaggaggtggtggtcctgggctcccaggagggcgcgatgcacaccgccctgaccggggccacggagatccagaccagcggcaccaccacgatcttcgccgggcacctcaagtgccgcctgaagatggacaagctgaccctcaagggcatgtcctacgtgatgtgcaccgggagcttcaagctggagaaggaggtggccgagacccagcacggcacggtcctggtccaggtgaagtacgagggcaccgacgcgccctgcaagatccccttctccacccaggacgagaagggggtcacccagaacggccggctgatcacggccaacccgatcgtgaccgacaaggagaagcccgtgaacatcgagaccgagccgcccttcggggagagctacatcgtcgtgggcgccggcgagaaggccctcaagctgtcctggttcaagcgcgggagctccatcggcaagatgttcgaggcgaccgcccgcggggcgcgccgcatggccatcctgggcgacacggcctgggacttcgggagcatcggcggcgtgttcacctccgtcgggaagctcgtgcaccaggtgttcggcaccgcgtacggggtcctgttcagcggcgtgtcctggaccatgaagatcgggatcggcatcctgctcacgtggctgggcctgaacagccggtccaccagcctctccatgacctgcatcgccgtggggatggtcaccctgtacctgggcgtgatggtgcaggccgacagcgggtgcgtcatcaactggaagggccgcgagctcaagtgcgggtccggcatcttcgtgacgaacgaggtgcacacctggaccgagcagtacaagttccaggccgacagcccgaagcggctgagcgccgcgatcggcaaggcctgggaggagggggtctgcggcatccgctccgccacccggctggagaacatcatgtggaagcagatcagcaacgagctcaaccacatcctgctggagaacgacatgaagttcaccgtggtggtcggggacgccaacggcatcctcgcccaggggaagaagatgatccgcccccagcccatggagcacaagtactcctggaagtcctggggcaaggcgaagatcatcggcgccgacatccagaacacgaccttcatcatcgacgggcccgacaccccggagtgccccgacggccagcgggcctggaacatctgggaggtggaggactacgggttcggcgtgttcaccacgaacatctggctgaagctgcgcgactcctacacccagatgtgcgaccaccggctcatgagcgccgcgatcaaggactccaaggccgtccacgccgacatgggctactggatcgagagcgagaagaacgagacctggaagctggcccgcgcctccttcatcgaggtgaagacctgcacgtggcccaagagccacaccctgtggtccaacggggtgctcgagagcgagatgatcatccccaagatctacggcgggccgatctcccagcacaactaccggcccggctacttcacccagaccgcggggccctggcacctgggcaagctggagctcgacttcgacctgtgcgagggcacgaccgtcgtggtggacgagcactgcgggaaccgcggcccgagcctgcggaccaccacggtcaccgggaagatcatccacgagtggtgctgccgctcctgcaccctgccgcccctgcggttccgcggcgaggacgggtgctggtacggcatggagatccggcccgtgaaggagaaggaggagaacctggtgcgcagcatggtctccgccggcagcggggaggtggacagcttctccctcggcatcctgtgcgtgagcatcatgatcgaggaggtcatgcggtcccgctggagccgcaagatgctgatgaccgggacgctcgccgtgttcctgctgctcatcatgggccagctgacctggaacgacctgatccggctctgcatcatggtgggggccaacgcctccgaccgcatgggcatgggcaccacccacctggcgctgatggccacgttcaagatgcggccgatgttcgccgtcgggctcctgttccgccggctgaccagccgcgaggtgctcctgctgaccatcggcctctccctggtcgccagcgtggagctgcccaactccctcgaggagctgggggacggcctggccatgggcatcatgatgctcaagctgctgaccgagttccagccctaccagctctggacgaccctgctgagcctcaccttcgtgaagaccacgctgtccctggactacgcgtggaagaccaccgccatggccctcagcatcgtctccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggccatcgggatcgtgagcatcctgctgtccagcctcctgaagaacgacgtccccctggcgggcccgctcatcgccggcgggatgctgatcgcctgctacgtgatcagcggctccagcgccgacctgtccctcgagaaggccgcggaggtgagctgggagcaggaggccgagcactccggggccagccactccatcctggtcgaggtgcaggacgacggcacgatgaagatcaaggacgaggagcgcgacgacaccctgaccatcctcctgaaggccaccctgctcgccgtgagcggggtctaccccatgtccatccccgcgacgctgttcgtgtggtacttctggcagcggaagaagcagcgcagcggcgtgctgtgggacaccccctccccgcccgaggtcgagcgggccgtgctcgacaacggcatctaccgcatcctgcagcgggggctgctgggccgcagccaggtgggggtcggcgtgttccaggacggggtgttccacaccatgtggcacgtcacccggggcgccgtgctcatgtaccagggcaagcgcctggagccctcctgggccagcgtgaagaaggacctgatctcctacgggggcgggtggcggttccagggcagctggaacacgggggaggaggtccaggtgatcgccgtggagcccggcaagaacccgaagaacgtccagaccacccccggcaccttcaagacgcccgagggggaggtgggcgcgatcgccctcgacttcaagcccgggacctccggcagcccgatcgtgaaccgcgagggcaagatcgtcgggctgtacggcaacggggtggtgaccacctccggcacgtacgtcagcgccatcgcccaggccaaggcgagccaggaggggcccctgcccgagatcgaggacgaggtgttcaagaagcggaacctcaccatcatggacctgcacccgggctccggcaagacccgcaagtacctgcccgccatcgtgcgggaggccatcaagcgcaagctccgcaccctgatcctggcccccacgcgggtcgtggcgagcgagatggccgaggccctcaaggggatgcccatccgctaccagaccaccgccgtgaagtccgagcacaccggccgggagatcgtcgacctgatgtgccacgccacgttcaccatgcgcctgctcagcccggtgcgggtgcccaactacaacatgatcatcatggacgaggcgcacttcaccgaccccgcctccatcgccgcccgcgggtacatcagcacccgggtcggcatgggggaggccgcggccatcttcatgacggccacgccgcccggctccgtggaggccttcccccagagcaacgccgtgatccaggacgaggagcgcgacatccccgagcggtcctggaacagcggctacgactggatcaccgacttccccgggaagaccgtctggttcgtgccctccatcaagagcggcaacgacatcgcgaactgcctgcgcaagaacgggaagcgggtgatccagctgtcccgcaagacgttcgacaccgagtaccagaagaccaagaacaacgactgggactacgtcgtgaccacggacatcagcgagatgggcgccaacttccgggccgaccgcgtgatcgacccccggcgctgcctcaagcccgtcatcctgaaggacgggcccgagcgggtgatcctggccggcccgatgcccgtcaccgtggcgtccgccgcccagcgccggggccgcatcgggcgcaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgggagaagtccgccgccatcgacggggagtaccgcctgcggggcgaggcccgcaagacgttcgtcgagctgatgcggcgcggcgacctccccgtgtggctgtcctacaaggtggccagcgaggggttccagtactccgaccggcgctggtgcttcgacggcgagcggaacaaccaggtcctggaggagaacatggacgtggagatctggaccaaggagggggagcgcaagaagctccggccccgctggctggacgcgcggacctacagcgacccgctggccctccgcgagttcaaggagttcgccgccggccggcgcagcgtgtccggcgacctgatcctggagatcgggaagctcccccagcacctgaccctgcgggcccagaacgcgctcgacaacctggtcatgctgcacaacagcgagcagggcgggaaggcctaccgccacgccatggaggagctccccgacaccatcgagacgctgatgctgctcgccctgatcgcggtgctgaccggcggggtgaccctcttcttcctgtccggcaagggcctggggaagaccagcatcggcctcctgtgcgtcacggcctccagcgccctgctctggatggcctccgtggagccccactggatcgccgcgagcatcatcctggagttcttcctgatggtgctcctgatcccggagcccgaccggcagcgcacgccccaggacaaccagctggcctacgtcgtgatcgggctcctgttcatgatcctgaccgtggccgccaacgagatgggcctcctggagaccacgaagaaggacctggggatcggctacgtcgccgcggagaaccaccagcacgccaccatgctcgacgtggacctgcacccggcctccgcctggaccctgtacgccgtggcgaccacggtcatcacccccatgatgcggcacaccatcgagaacaccacggccaacatcagcctcaccgccatcgccaaccaggccgcgatcctgatgggcctggacaaggggtggcccatctccaagatggacatcggcgtgcccctcctggccctggggtgctacagccaggtgaacccgctcaccctgaccgccgccgtcctgatgctcgtggcgcactacgccatcatcggccccgggctgcaggccaaggccacgcgcgaggcccagaagcgcaccgcggccggcatcatgaagaaccccaccgtggacggcatcgtcgccatcgacctggaccccgtggtgtacgacgccaagttcgagaagcagctcgggcagatcatgctgctgatcctctgcacctcccagatcctgctgatgcggacgacctgggccctctgcgagagcatcaccctggcgaccggcccgctgacgaccctctgggaggggtcccccggcaagttctggaacaccaccatcgccgtcagcatggccaacatcttccgcggctcctacctggccggggccggcctggcgttcagcctcatgaagtccctcgggggcgggcggcgcggcacgggcgcccagggggagaccctgggcgagaagtggaagcggcagctcaaccagctgagcaagagcgagttcaacacctacaagcgctccgggatcatggaggtggaccggagcgaggccaaggagggcctgaagcgcggggagaccacgaagcacgccgtgtcccggggcaccgcgaagctccgctggttcgtcgagcggaacctggtgaagcccgagggcaaggtgatcgacctggggtgcggccgcgggggctggagctactactgcgccgggctgaagaaggtcaccgaggtgaagggctacaccaagggcgggcccggccacgaggagccgatccccatggccacctacgggtggaacctcgtgaagctgcactccggcaaggacgtcttcttcatgccgcccgagaagtgcgacacgctgctctgcgacatcggggagagctccccgaaccccaccatcgaggagggccggaccctgcgcgtgctgaagatggtggagccctggctccggggcaaccagttctgcatcaagatcctgaacccctacatgccgagcgtcgtggagaccctggagcgcatgcagcggaagcacgggggcatgctcgtgcgcaaccccctgtcccggaacagcacgcacgagatgtactgggtctcctgcgggaccggcaacatcgtgagcgccgtgaacatgacctcccgcatgctgctcaaccgcttcaccatggcccaccggaagcccacgtacgagcgcgacgtcgacctgggcgcggggacccggcacgtggccgtggagcccgaggtcgccaacctggacatcatcggccagcgcatcgagaacatcaagaacgagcacaagagcacctggcactacgacgaggacaacccgtacaagacctgggcctaccacgggtcctacgaggtgaagcccagcggctccgccagctccatggtcaacggggtggtgcggctcctgacgaagccctgggacgtcatccccatggtgacccagatcgcgatgaccgacaccacgccgttcggccagcagcgcgtgttcaaggagaaggtcgacacccggacgccccgcgccaagcggggcaccacgcagatcatggaggtgaccgccaagtggctgtgggggttcctcagccgcaacaagaagccccggatctgcacccgcgaggagttcacccggaaggtgcgcagcaacgccgccatcggcgcggtcttcgtggacgagaaccagtggaactccgccaaggaggccgtggaggacgagcggttctgggacctggtccaccgcgagcgggagctgcacaagcaggggaagtgcgccacgtgcgtgtacaacatgatgggcaagcgcgagaagaagctcggggagttcggcaaggcgaagggcagccgggccatctggtacatgtggctgggggcccgcttcctggagttcgaggccctcggcttcatgaacgaggaccactggttctcccgggagaacagcctgtccggggtggagggcgaggggctgcacaagctcggctacatcctgcgcgacatcagcaagatcccgggcgggaacatgtacgccgacgacaccgcgggctgggacacccgcatcaccgaggacgacctgcagaacgaggccaagatcacggacatcatggagcccgagcacgcccagctcgccacctccatcttcaagctgacctaccagaacaaggtcgtgcgggtgcagcgccccgccaagaacgggaccgtcatggacgtgatcagccggcgcgaccagcggggctccggccaggtggggacgtacggcctgaacaccttcaccaacatggaggtccagctcatccgccagatggagagcgaggggatcttcctgccctccgagctggagaccccgaacctcgcggagcgggccctggactggctggagaagaacggcgccgagcgcctcaagcggatggccatcagcggggacgactgcgtggtgaagcccatcgacgaccgcttcgccacggcgctgaccgccctgaacgacatgggcaaggtccggaaggacatcccccagtgggagccctccaagggctggaacgactggcagcaggtcccgttctgcagccaccacttccaccagctcatcatgaaggacgggcgcgagatcgtggtcccctgccggaaccaggacgagctggtgggccgcgcccgggtgtcccagggggccggctggagcctgcgcgagaccgcctgcctcgggaagtcctacgcgcagatgtggcagctgatgtacttccaccggcgcgacctgcggctcgccgccaacgccatctgcagcgcggtccccgtggactgggtgcccaccagccgcaccacgtggtccatccacgcccaccaccagtggatgaccaccgaggacatgctgagcgtctggaaccgcgtgtggatcgaggagaacccgtggatggaggacaagacccacgtgtccagctgggaggaggtcccctacctgggcaagcgggaggaccagtggtgcggctccctcatcgggctgacggcccgcgccacctgggccaccaacatccaggtggcgatcaaccaggtgcggcgcctgatcggcaacgagaactacctcgactacatgaccagcatgaagcggttcaagaacgagtccgacagcgagggggccctgtggtga

SEQ ID NO: 8186 - RNA, 9879 nt, synthetic construct
  misc_feature 1..9879: note = derived and/or modified CDS sequence (opt1) from DENV-1__KJ189359__SS-prME
  source 1..9879: mol_type = other RNA
agcgtgaccatgctgctcatgctgctgcccaccgtgctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgggagaagcggtccgtggccctggcgccccacgtcggcctggggctcgagacccgcaccgagacctggatgagctccgagggcgcctggaagcagatccagcgggtggagacctgggccctgcgccaccccgggttcacggtgatcgccttcttcctggcccacgcgatcggcaccagcatcacccagaaggggatcatcttcatcctcctgatgctggtcaccccctccatggccatgcggtgcgtgggcatcggcaaccgcgacttcgtggaggggctcagcggcgccacgtgggtcgacgtggtgctggagcacgggtcctgcgtcaccaccatggccaagaacaagcccaccctggacatcgagctcctgaagacggaggtgaccaaccccgccgtgctgcggaagctctgcatcgaggcgaagatcagcaacaccaccacggactcccgctgcccgacccagggcgaggccaccctggtcgaggagcaggacgccaacttcgtgtgccggcgcaccttcgtggaccggggctgggggaacggctgcgggctgttcggcaaggggagcctcctgacgtgcgccaagttcaagtgcgtcaccaagctggagggcaagatcgtgcagtacgagaacctcaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctgaccctcgactgcagcccccggaccggcctggacttcaacgagatggtgctgctcacgatgaaggagaagtcctggctggtgcacaagcagtggttcctggacctcccgctgccctggacctccggggccagcaccagccaggagacctggaaccggcaggacctgctcgtcacgttcaagaccgcccacgccaagaagcaggaggtggtggtcctgggctcccaggagggcgcgatgcacaccgccctgaccggggccacggagatccagaccagcggcaccaccacgatcttcgccgggcacctcaagtgccgcctgaagatggacaagctgaccctcaagggcatgtcctacgtgatgtgcaccgggagcttcaagctggagaaggaggtggccgagacccagcacggcacggtcctggtccaggtgaagtacgagggcaccgacgcgccctgcaagatccccttctccacccaggacgagaagggggtcacccagaacggccggctgatcacggccaacccgatcgtgaccgacaaggagaagcccgtgaacatcgagaccgagccgcccttcggggagagctacatcgtcgtgggcgccggcgagaaggccctcaagctgtcctggttcaagcgcgggagctccatcggcaagatgttcgaggcgaccgcccgcggggcgcgccgcatggccatcctgggcgacacggcctgggacttcgggagcatcggcggcgtgttcacctccgtcgggaagctcgtgcaccaggtgttcggcaccgcgtacggggtcctgttcagcggcgtgtcctggaccatgaagatcgggatcggcatcctgctcacgtggctgggcctgaacagccggtccaccagcctctccatgacctgcatcgccgtggggatggtcaccctgtacctgggcgtgatggtgcaggccgacagcgggtgcgtcatcaactggaagggccgcgagctcaagtgcgggtccggcatcttcgtgacgaacgaggtgcacacctggaccgagcagtacaagttccaggccgacagcccgaagcggctgagcgccgcgatcggcaaggcctgggaggagggggtctgcggcatccgctccgccacccggctggagaacatcatgtggaagcagatcagcaacgagctcaaccacatcctgctggagaacgacatgaagttcaccgtggtggtcggggacgccaacggcatcctcgcccaggggaagaagatgatccgcccccagcccatggagcacaagtactcctggaagtcctggggcaaggcgaagatcatcggcgccgacatccagaacacgaccttcatcatcgacgggcccgacaccccggagtgccccgacggccagcgggcctggaacatctgggaggtggaggactacgggttcggcgtgttcaccacgaacatctggctgaagctgcgcgactcctacacccagatgtgcgaccaccggctcatgagcgccgcgatcaaggactccaaggccgtccacgccgacatgggctactggatcgagagcgagaagaacgagacctggaagctggcccgcgcctccttcatcgaggtgaagacctgcacgtggcccaagagccacaccctgtggtccaacggggtgctcgagagcgagatgatcatccccaagatctacggcgggccgatctcccagcacaactaccggcccggctacttcacccagaccgcggggccctggcacctgggcaagctggagctcgacttcgacctgtgcgagggcacgaccgtcgtggtggacgagcactgcgggaaccgcggcccgagcctgcggaccaccacggtcaccgggaagatcatccacgagtggtgctgccgctcctgcaccctgccgcccctgcggttccgcggcgaggacgggtgctggtacggcatggagatccggcccgtgaaggagaaggaggagaacctggtgcgcagcatggtctccgccggcagcggggaggtggacagcttctccctcggcatcctgtgcgtgagcatcatgatcgaggaggtcatgcggtcccgctggagccgcaagatgctgatgaccgggacgctcgccgtgttcctgctgctcatcatgggccagctgacctggaacgacctgatccggctctgcatcatggtgggggccaacgcctccgaccgcatgggcatgggcaccacctacctggcgctgatggccacgttcaagatgcggccgatgttcgccgtcgggctcctgttccgccggctgaccagccgcgaggtgctcctgctgaccatcggcctctccctggtcgccagcgtggagctgcccaactccctcgaggagctgggggacggcctggccatgggcatcatgatgctcaagctgctgaccgagttccagccccaccagctctggacgaccctgctgagcctcaccttcgtgaagaccacgctgtccctggactacgcgtggaagaccaccgccatggccctcagcatcgtctccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggccatcgggatcgtgagcatcctgctgtccagcctcctgaagaacgacgtccccctggcgggcccgctcatcgccggcgggatgctgatcgcctgctacgtgatcagcggctccagcgccgacctgtccctcgagaaggccgcggaggtgagctgggagcaggaggccgagcactccggggccagccactccatcctggtcgaggtgcaggacgacggcacgatgaagatcaaggacgaggagcgcgacgacaccctgaccatcctcctgaaggccaccctgctcgccgtgagcggggtctaccccatgtccatccccgcgacgctgttcgtgtggtacttctggcagcggaagaagcagcgcagcggcgtgctgtgggacaccccctccccgcccgaggtcgagcgggccgtgctcgacaacggcatctaccgcatcctgcagcgggggctgctgggccgcagccaggtgggggtcggcgtgttccaggacggggtgttccacaccatgtggcacgtcacccggggcgccgtgctcatgtaccagggcaagcgcctggagccctcctgggccagcgtgaagaaggacctgatctcctacgggggcgggtggcggttccagggcagctggaacacgggggaggaggtccaggtgatcgccgtggagcccggcaagaacccgaagaacgtccagaccacccccggcaccttcaagacgcccgagggggaggtgggcgcgatcgccctcgacttcaagcccgggacctccggcagcccgatcgtgaaccgcgagggcaagatcgtcgggctgtacggcaacggggtggtgaccacctccggcacgtacgtcagcgccatcgcccaggccaaggcgagccaggaggggcccctgcccgagatcgaggacgaggtgttcaagaagcggaacctcaccatcatggacctgcacccgggctccggcaagacccgccggtacctgcccgccatcgtgcgcgaggccatcaagcgcaagctccggaccctgatcctggcccccacgcgcgtcgtggcgagcgagatggccgaggccctcaaggggatgcccatccggtaccagaccaccgccgtgaagtccgagcacaccggccgcgagatcgtcgacctgatgtgccacgccacgttcaccatgcggctgctcagcccggtgcgcgtgcccaactacaacatgatcatcatggacgaggcgcacttcaccgaccccgcctccatcgccgcccgggggtacatcagcacccgcgtcggcatgggggaggccgcggccatcttcatgacggccacgccgcccggctccgtggaggccttcccccagagcaacgccgtgatccaggacgaggagcgggacatccccgagcgctcctggaacagcggctacgactggatcaccgacttccccgggaagaccgtctggttcgtgccctccatcaagagcggcaacgacatcgcgaactgcctgcggaagaacgggaagcgcgtgatccagctgtcccggaagacgttcgacaccgagtaccagaagaccaagaacaacgactgggactacgtcgtgaccacggacatcagcgagatgggcgccaacttccgcgccgaccgggtgatcgacccccgccggtgcctcaagcccgtcatcctgaaggacgggcccgagcgcgtgatcctggccggcccgatgcccgtcaccgtggcgtccgccgcccagcggcgcggccgcatcgggcggaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgcgagaagtccgccgccatcgacggggagtaccggctgcgcggcgaggcccggaagacgttcgtcgagctgatgcgccggggcgacctccccgtgtggctgtcctacaaggtggccagcgaggggttccagtactccgaccgccggtggtgcttcgacggcgagcgcaacaaccaggtcctggaggagaacatggacgtggagatctggaccaaggagggggagcggaagaagctccgcccccggtggctggacgcgcgcacctacagcgacccgctggccctccgggagttcaaggagttcgccgccggccgccggagcgtgtccggcgacctgatcctggagatcgggaagctcccccagcacctgaccctgcgcgcccagaacgcgctcgacaacctggtcatgctgcacaacagcgagcagggcgggaaggcctaccggcacgccatggaggagctccccgacaccatcgagacgctgatgctgctcgccctgatcgcggtgctgaccggcggggtgaccctcttcttcctgtccggcaagggcctggggaagaccagcatcggcctcctgtgcgtcacggcctccagcgccctgctctggatggcctccgtggagccccactggatcgccgcgagcatcatcctggagttcttcctgatggtgctcctgatcccggagcccgaccgccagcggacgccccaggacaaccagctggcctacgtcgtgatcgggctcctgttcatgatcctgaccgtggccgccaacgagatgggcctcctggagaccacgaagaaggacctggggatcggctacgtcgccgcggagaaccaccagcacaccaccatgctcgacgtggacctgcacccggcctccgcctggaccctgtacgccgtggccacgaccgtcatcacccccatgatgcgccacaccatcgagaacacgaccgcgaacatcagcctcaccgccatcgccaaccaggccgccatcctgatgggcctggacaaggggtggcccatctccaagatcgacatcggcgtgcccctcctggcgctggggtgctacagccaggtgaacccgctcaccctgacggccgccgtcctgatgctcgtggcccactacgcgatcatcggccccgggctgcaggccaaggccacccgcgaggcccagaagcggaccgccgcgggcatcatgaagaaccccaccgtggacggcatcgtcgccatcgacctggaccccgtggtgtacgacgccaagttcgagaagcagctcgggcagatcatgctgctgatcctctgcacgtcccagatcctgctgatgcgcaccacctgggccctctgcgagagcatcaccctggccacgggcccgctgaccaccctctgggaggggtcccccggcaagttctggaacaccacgatcgcggtcagcatggccaacatcttccggggctcctacctggccggggccggcctggccttcagcctcatgaagtccctcgggggcgggcgccgggggaccggcgcgcagggggagaccctgggcgagaagtggaagcgccagctcaaccagctgagcaagagcgagttcaacacctacaagcggtccgggatcatggaggtggaccgcagcgaggccaaggagggcctgaagcgcggggagacgaccaagcacgccgtgtcccgcggcaccgccaagctccggtggttcgtcgagcgcaacctggtgaagcccgagggcaaggtgatcgacctggggtgcggccgcgggggctggagctactactgcgcggggctgaagaaggtcaccgaggtgaagggctacaccaagggcgggcccggccacgaggagccgatccccatggccacgtacgggtggaacctcgtgaagctgcactccggcaaggacgtcttcttcatgccgcccgagaagtgcgacaccctgctctgcgacatcggggagagctccccgaaccccaccatcgaggagggccgcaccctgcgggtgctgaagatggtggagccctggctccgcggcaaccagttctgcatcaagatcctgaacccctacatgccgagcgtcgtggagacgctggagcggatgcagcgcaagcacgggggcatgctcgtgcggaaccccctgtcccgcaacagcacccacgagatgtactgggtctcctgcgggaccggcaacatcgtgagcgccgtgaacatgacctcccgcatgctgctcaaccggttcacgatggcccaccgcaagcccacctacgagcgggacgtcgacctgggcgccgggacccgccacgtggcggtggagcccgaggtcgccaacctggacatcatcggccagcggatcgagaacatcaagaacgagcacaagagcacctggcactacgacgaggacaacccgtacaagacgtgggcctaccacgggtcctacgaggtgaagcccagcggctccgccagctccatggtcaacggggtggtgcgcctcctgaccaagccctgggacgtcatccccatggtgacccagatcgccatgaccgacacgaccccgttcggccagcagcgggtgttcaaggagaaggtcgacacccgcacgccccgggcgaagcgcggcacgacccagatcatggaggtgaccgccaagtggctgtgggggttcctcagccggaacaagaagccccgcatctgcacccgggaggagttcacgcgcaaggtgcggagcaacgccgccatcggcgccgtcttcgtggacgagaaccagtggaacaccgcgaaggaggccgtggaggacgagcgcttctgggacctggtccaccgggagcgcgagctgcacaagcaggggaagtgcgcgacctgcgtgtacaacatgatgggcaagcgggagaagaagctcggggagttcggcaaggccaagggctcccgcgcgatctggtacatgtggctgggggcccggttcctggagttcgaggccctcggcttcatgaacgaggaccactggttcagccgcgagaactccctgagcggggtggagggcgaggggctgcacaagctcggctacatcctgcgcgacatctccaagatcccgggcgggaacatgtacgccgacgacaccgccggctgggacacgcggatcaccgaggacgacctgcagaacgaggcgaagatcaccgacatcatggagcccgagcacgccctcctggccaccagcatcttcaagctgacgtaccagaacaaggtcgtgcgcgtgcagcggcccgccaagaacgggaccgtcatggacgtgatctcccgccgggaccagcgcggcagcggccaggtggggacctacggcctcaacaccttcacgaacatggaggtccagctgatccggcagatggagtccgaggggatcttcctgcccagcgagctcgagaccccgaacctggccgagcgcgcgctggactggctcgagaagcacggcgccgagcggctgaagcgcatggccatctccggggacgactgcgtggtgaagcccatcgacgaccggttcgccaccgccctgaccgcgctcaacgacatgggcaaggtccgcaaggacatcccccagtgggagcccagcaagggctggaacgactggcagcaggtcccgttctgctcccaccacttccaccagctgatcatgaaggacgggcgggagatcgtggtcccctgccgcaaccaggacgagctggtgggccgggcccgcgtgagccagggggccggctggtccctccgggagaccgcctgcctgggcaagagctacgcccagatgtggcagctgatgtacttccaccgccgggacctccgcctggcggccaacgccatctgctccgccgtccccgtggactgggtgcccacgagccgcaccacctggagcatccacgcgcaccaccagtggatgaccacggaggacatgctgtccgtctggaaccgggtgtggatcgaggagaacccgtggatggaggacaagacccacgtgagctcctgggaggaggtcccctacctcggcaagcgcgaggaccagtggtgcggcagcctgatcgggctgaccgcccgggccacctgggccacgaacatccaggtggccatcaaccaggtgcgccggctcatcggcaacgagaactacctggactacatgacctccatgaagcgcttcaagaacgagagcgactccgagggggcgctgtggtga

SEQ ID NO: 8187 - RNA, 9879 nt, synthetic construct
  misc_feature 1..9879: note = derived and/or modified CDS sequence (opt1) from DENV-1__KJ189360__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctcgtccaccagatcttcggcaccgcctacggggtgctgttcagcggcgtgtcctggaccatgaagatcgggatcggcatcctgctcacgtggctgggcctgaacagccggtccaccagcctctccatgacctgcatcgccgtcgggatggtgaccctgtacctgggcgtgatggtccaggccgacagcgggtgcgtgatcaactggaagggccgcgagctcaagtgcgggtccggcatcttcgtgacgaacgaggtccacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtggtcgtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtggaggactacgggttcggcgtcttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtgaagacctgcacgtggcccaagagccacaccctgtggtccaacggggtcctcgagagcgagatgatcatccccaagatctacggcgggccgatctcccagcacaactaccggcccggctacttcacccagaccgccgggccctggcacctgggcaagctggagctcgacttcgacctgtgcgagggcacgaccgtggtggtcgacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtgaaggagaaggaggagaacctggtccgcagcatggtgtccgccggcagcggggaggtggacagcttctccctcggcatcctgtgcgtcagcatcatgatcgaggaggtgatgcggtcccgctggagccgcaagatgctgatgaccgggacgctcgccgtgttcctgctgctcatcatgggccagctgacctggaacgacctgatccggctctgcatcatggtcggggccaacgcgtccgaccgcatgggcatgggcaccacctacctggccctgatggccacgttcaagatgcggccgatgttcgccgtggggctcctgttccgccggctgaccagccgcgaggtgctcctgctgaccatcggcctctccctggtcgccagcgtggagctgcccaactccctcgaggagctgggggacggcctggcgatgggcatcatgatgctcaagctgctgaccgagttccagccccaccagctctggacgaccctgctgagcctcaccttcgtcaagaccacgctgtccctggactacgcctggaagaccaccgccatggccctcagcatcgtgtccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggcgatcgggatcgtcagcatcctgctgtccagcctcctgaagaacgacgtgcccctggccggcccgctcatcgccggcgggatgctgatcgcctgctacgtgatcagcggctccagcgccgacctgtccctcgagaaggcggccgaggtcagctgggagcaggaggccgagcactccggggccagccactccatcctggtggaggtgcaggacgacggcacgatgaagatcaaggacgaggagcgcgacgacaccctgaccatcctcctgaaggccaccctgctcgcggtcagcggggtgtaccccatgtccatccccgccacgctgttcgtgtggtacttctggcagaagaagaagcagcggagcggcgtcctgtgggacaccccctccccgcccgaggtggagcgcgccgtgctcgacaacggcatctaccggatcctgcagcgcgggctgctgggccggagccaggtcggggtgggcgtgttccaggacggggtcttccacaccatgtggcacgtgacccgcggcgccgtgctcatgtaccagggcaagcggctggagccctcctgggccagcgtcaagaaggacctgatctcctacgggggcgggtggcgcttccagggcagctggaacacgggggaggaggtccaggtgatcgcggtcgagcccggcaagaacccgaagaacgtgcagaccacccccggcaccttcaagacgcccgagggggaggtgggcgccatcgccctcgacttcaagcccgggacctccggcagcccgatcgtcaaccgggagggcaagatcgtggggctgtacggcaacggggtggtcaccacctccggcacgtacgtgagcgccatcgcccaggcgaaggccagccaggaggggcccctgcccgagatcgaggacgaggtgttcaagaagcgcaacctcaccatcatggacctgcacccgggctccggcaagacccggcgctacctgcccgccatcgtccgggaggccatcaagcgcaagctccgcaccctgatcctggcgcccacgcgggtggtggccagcgagatggccgaggccctcaaggggatgcccatccgctaccagaccaccgccgtcaagtccgagcacaccggccgggagatcgtggacctgatgtgccacgcgacgttcaccatgcgcctgctcagcccggtgcgggtccccaactacaacatgatcatcatggacgaggcccacttcaccgaccccgcctccatcgccgcccgcgggtacatcagcacccgggtgggcatgggggaggcggccgccatcttcatgacggccacgccgcccggctccgtggaggccttcccccagagcaacgcggtcatccaggacgaggagcgcgacatccccgagcggtcctggaacagcggctacgactggatcaccgacttccccgggaagaccgtgtggttcgtgccctccatcaagagcggcaacgacatcgccaactgcctgcgcaagaacgggaagcgggtcatccagctgtcccgcaagacgttcgacaccgagtaccagaagaccaagaacaacgactgggactacgtggtgaccacggacatcagcgagatgggcgccaacttccgggccgaccgcgtcatcgacccccggcgctgcctcaagcccgtgatcctgaaggacgggcccgagcgggtgatcctggcgggcccgatgcccgtcaccgccgcctccgccgcccagcgccggggccgcatcgggcgcaaccagaacaaggagggcgaccagtacgtgtacatggggcagcccctcaacaacgacgaggaccacgcgcactggaccgaggccaagatgctgctggacaacatcaacacccccgagggcatcatcccggccctcttcgagcccgagcgggagaagtccgccgccatcgacggggagtaccgcctgcggggcgaggcgcgcaagacgttcgtcgagctgatgcggcgcggcgacctccccgtgtggctgtcctacaaggtggccagcgaggggttccagtactccgaccggcgctggtgcttcgacggcgagcggaacaaccaggtcctggaggagaacatggacgtggagatctggaccaaggagggggagcgcaagaagctccggccccgctggctggacgcccggacctacagcgacccgctggccctccgcgagttcaaggagttcgccgcgggccggcgcagcgtgtccggcgacctgatcctggagatcgggaagctcccccagcacctgaccctgcgggcccagaacgccctcgacaacctggtcatgctgcacaacagcgagcagggcgggaaggcctaccgccacgcgatggaggagctccccgacaccatcgagacgctgatgctgctcgccctgatcgccgtgctgaccggcggggtgaccctcttcttcctgtccggcaagggcctggggaagaccagcatcggcctcctgtgcgtcacggcctccagcgccctgctctggatggcgtccgtggagccccactggatcgccgccagcatcatcctggagttcttcctgatggtgctcctgatcccggagcccgaccggcagcgcacgccccaggacaaccagctggcctacgtcgtgatcgggctcctgttcatgatcctgaccgtggccgcgaacgagatgggcctcctggagaccacgaagaaggacctggggatcggctacgtcgccgccgagaaccaccagcacgccaccatgctcgacgtggacctgcacccggcctccgcgtggaccctgtacgccgtggccaccacggtcatcacccccatgatgcggcacaccatcgagaacaccacggccaacatcagcctcaccgccatcgcgaaccaggccgccatcctgatgggcctggacaaggggtggcccatctccaagatggacatcggcgtgcccctcctggccctggggtgctacagccaggtgaacccgctcaccctgaccgcggccgtcctgatgctcgtggcccactacgccatcatcggccccgggctgcaggccaaggcgacgcgcgaggcccagaagcgcaccgccgccggcatcatgaagaaccccaccgtggacggcatcgtcgccatcgacctggaccccgtggtgtacgacgcgaagttcgagaagcagctcgggcagatcatgctgctgatcctctgcacctcccagatcctgctgatgcggacgacctgggccctctgcgagagcatcaccctggccaccggcccgctgacgaccctctgggaggggtcccccggcaagttctggaacaccaccatcgccgtcagcatggccaacatcttccgcggctcctacctggcgggggccggcctggccttcagcctcatgaagtccctcgggggcgggcggcgcggcacgggcgcccagggggagaccctgggcgagaagtggaagcggcagctcaaccagctgagcaagagcgagttcaacacctacaagcgctccgggatcatggaggtggaccggagcgaggcgaaggagggcctgaagcgcggggagaccacgaagcacgccgtgtcccggggcaccgccaagctccgctggttcgtcgagcggaacctggtgaagcccgagggcaaggtgatcgacctggggtgcggccgcgggggctggagctactactgcgccgggctgaagaaggtcaccgaggtgaagggctacaccaagggcgggcccggccacgaggagccgatccccatggccacctacgggtggaacctcgtgaagctgcactccggcaaggacgtcttcttcatgccgcccgagaagtgcgacacgctgctctgcgacatcggggagagctccccgaaccccaccatcgaggagggccggaccctgcgcgtgctgaagatggtggagccctggctccggggcaaccagttctgcatcaagatcctgaacccctacatgccgagcgtcgtggagaccctggagcgcatgcagcggaagcacgggggcatgctcgtgcgcaaccccctgtcccggaacagcacgcacgagatgtactgggtctcctgcgggaccggcaacatcgtgagcgcggtgaacatgacctcccgcatgctgctcaaccgcttcaccatggcccaccggaagcccacgtacgagcgcgacgtcgacctgggcgccgggacccggcacgtggccgtggagcccgaggtcgccaacctggacatcatcggccagcgcatcgagaacatcaagaacgagcacaagagcacctggcactacgacgaggacaacccgtacaagacctgggcgtaccacgggtcctacgaggtgaagcccagcggctccgccagctccatggtgaacggggtcgtgcggctcctgacgaagccctgggacgtcatccccatggtgacccagatcgccatgaccgacaccacgccgttcggccagcagcgcgtgttcaaggagaaggtcgacacccggacgccccgcgccaagcggggcaccacgcagatcatggaggtgaccgccaagtggctgtgggggttcctcagccgcaacaagaagccccggatctgcacccgcgaggagttcacccggaaggtgcgcagcaacgcggccatcggcgccgtcttcgtggacgagaaccagtggaactccgccaaggaggcggtggaggacgagcggttctgggacctggtccaccgcgagcgggagctgcacaagcaggggaagtgcgccacgtgcgtgtacaacatgatgggcaagcgcgagaagaagctcggggagttcggcaaggccaagggcagccgggccatctggtacatgtggctgggggcccgcttcctggagttcgaggcgctcggcttcatgaacgaggaccactggttctcccgggagaacagcctgtccggggtggagggcgaggggctgcacaagctcggctacatcctgcgcgacatcagcaagatcccgggcgggaacatgtacgccgacgacaccgccggctgggacacccgcgtcaccgaggacgacctgcagaacgaggccaagatcacggacatcatggagcccgagcacgccctcctggcgacctccatcttcaagctgacctaccagaacaaggtggtgcgggtccagcgccccgccaagaacgggaccgtgatggacgtgatcagccggcgcgaccagcggggctccggccaggtcgggacgtacggcctcaacaccttcaccaacatggaggtgcagctgatccgccagatggagagcgaggggatcttcctgccctccgagctcgagaccccgaacctggccgagcgggccctggactggctcgagaagcacggcgccgagcgcctgaagcggatggcgatcagcggggacgactgcgtggtcaagcccatcgacgaccgcttcgccacggccctgaccgccctcaacgacatgggcaaggtgcggaaggacatcccccagtgggagccctccaagggctggaacgactggcagcaggtcccgttctgcagccaccacttccaccagctgatcatgaaggacgggcgcgagatcgtcgtgccctgccggaaccaggacgagctggtgggccgcgcccgggtctcccagggggcgggctggagcctccgcgagaccgcctgcctggggaagtcctacgcccagatgtggcagctgatgtacttccaccggcgcgacctccggctggccgcgaacgccatctgcagcgccgtgcccgtggactgggtccccaccagccgcaccacgtggtccatccacgcccaccaccagtggatgaccaccgaggacatgctgagcgtgtggaaccgcgtgtggatcgaggagaacccgtggatggagaacaagacccacgtctccagctgggaggaggtgccctacctcggcaagcgggaggaccagtggtgcggctccctgatcgggctgacggcccgcgcgacctgggccaccaacatccaggtggccatcaaccaggtccggcgcctcatcggcaacgagaactacctggactacatgaccagcatgaagcggttcaagaacgagtccgacagcgagggggccctgtggtga

SEQ ID NO: 8188 - RNA, 9879 nt, synthetic construct
  misc_feature 1..9879: note = derived and/or modified CDS sequence (opt1) from DENV-1__KJ189361__SS-prME
  source 1..9879: mol_type = other RNA
agcgtgaccatgctgctcatgctgctgcccaccgccatggccttccacctcaccacccgcggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccttcttcctggcgcacgccatcggcaccagcatcacccagaaggggatcatcttcatcctgctcatgctggtgaccccctccatggccatgcggtgcgtcggcatcggcaaccgcgacttcgtggaggggctgagcggcgccacgtgggtggacgtcgtgctcgagcacgggtcctgcgtgaccaccatggccaagaacaagcccaccctggacatcgagctgctcaagacggaggtcaccaaccccgcggtgctgcggaagctgtgcatcgaggccaagatcagcaacaccaccacggactcccgctgcccgacccagggcgaggccaccctcgtggaggagcaggacgccaacttcgtctgccggcgcaccttcgtggaccggggctgggggaacggctgcgggctgttcggcaaggggagcctgctcacgtgcgccaagttcaagtgcgtgaccaagctggagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctcaccgactacggggccctgaccctggactgcagcccccggaccggcctcgacttcaacgagatggtcctgctgacgatgaaggagaagtcctggctcgtgcacaagcagtggttcctggacctgccgctcccctggacctccggggccagcaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcatgtcctacgtcatgtgcaccgggagcttcaagctcgagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctgaagctctcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctggtccaccagatcttcggcaccgcctacggggtcctgttcagcggcgtgtcctggaccatgaagatcgggatcggcatcctgctgacgtggctcggcctgaacagccggtccaccagcctgtccatgacctgcatcgccgtcgggatggtgaccctctacctgggcgtgatggtccaggccgacagcgggtgcgtgatcaactggaagggccgcgagctgaagtgcgggtccggcatcttcgtgacgaacgaggtccacacctggaccgagcagtacaagttccaggccgacagcccgaagcggctcagcgcggccatcggcaaggcctgggaggagggggtgtgcggcatccgctccgccacccggctggagaacatcatgtggaagcagatcagcaacgagctgaaccacatcctcctggagaacgacatgaagttcaccgtggtcgtgggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtggaggactacgggttcggcgtcttcaccacgaacatctggctcaagctgcgcgactcctacacccagatgtgcgaccaccggctgatgagcgcggccatcaaggactccaaggccgtgcacgccgacatgggctactggatcgagagcgagaagaacgagacctggaagctcgcccgcgcgtccttcatcgaggtgaagacctgcacgtggcccaagagccacaccctgtggtccaacggggtcctggagagcgagatgatcatccccaagatctacggcgggccgatctcccagcacaactaccggcccggctacttcacccagaccgccgggccctggcacctcggcaagctggagctggacttcgacctctgcgagggcacgaccgtggtggtcgacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtgaaggagaaggaggagaacctggtccgcagcatggtgtccgccggcagcggggaggtggacagcttctccctgggcatcctctgcgtcagcatcatgatcgaggaggtgatgcggtcccgctggagccgcaagatgctgatgaccgggacgctggccgtgttcctcctgctgatcatgggccagctcacctggaacgacctgatccggctgtgcatcatggtcggggccaacgcgtccgaccgcatgggcatgggcaccacctacctcgccctgatggccacgttcaagatgcggccgatgttcgccgtggggctcctcttccgccggctgaccagccgcgaggtgctgctcctgaccatcggcctgtccctcgtcgccagcgtggagctgcccaactccctggaggagctcggggacggcctggcgatgggcatcatgatgctgaagctcctgaccgagttccagccccaccagctgtggacgaccctcctgagcctgaccttcgtcaagaccacgctctccctggactacgcctggaagaccaccgccatggccctgagcatcgtgtccctcttccccctgtgcctgagcaccacgtcccagaagaccacctggctcccggtgctgctggggagcttcggctgcaagcccctcaccatgttcctgatcaccgagaacaagatctgggggcggaagtcctggcccctgaacgagggcatcatggcgatcgggatcgtcagcatcctcctgtccagcctgctcaagaacgacgtgcccctggccggcccgctgatcgccggcgggatgctcatcgcctgctacgtgatcagcggctccagcgccgacctgtccctggagaaggcggccgaggtcagctgggagcaggaggccgagcactccggggccagccactccatcctcgtggaggtgcaggacgacggcacgatgaagatcaaggacgaggagcgcgacgacaccctgaccatcctgctcaaggccaccctgctggcggtcagcggggtgtaccccatgtccatccccgccaccctcttcgtgtggtacttctggcagaagaagaagcagcggagcggcgtcctgtgggacaccccctccccgcccgaggtggagcgcgccgtgctggacaacggcatctaccggatcctccagcgcgggctgctgggccggagccaggtcggggtgggcgtgttccaggacggggtcttccacaccatgtggcacgtgacccgcggcgccgtgctgatgtaccagggcaagcggctcgagccctcctgggccagcgtcaagaaggacctgatctcctacgggggcgggtggcgcttccagggcagctggaacacgggggaggaggtccaggtgatcgcggtcgagcccggcaagaacccgaagaacgtgcagaccacccccggcaccttcaagacgcccgagggggaggtgggcgccatcgccctggacttcaagcccgggacctccggcagcccgatcgtcaaccgggagggcaagatcgtggggctctacggcaacggggtggtcaccacctccggcacgtacgtgagcgccatcgcccaggcgaaggccagccaggaggggcccctgcccgagatcgaggacgaggtgttcaagaagcgcaacctgaccatcatggacctccacccgggctccggcaagacccggcgctacctgcccgccatcgtccgggaggccatcaagcgcaagctgcgcaccctcatcctggcgcccacgcgggtggtggccagcgagatggccgaggccctgaaggggatgcccatccgctaccagaccaccgccgtcaagtccgagcacaccggccgggagatcgtggacctcatgtgccacgcgacgttcaccatgcgcctgctgagcccggtgcgggtccccaactacaacatgatcatcatggacgaggcccacttcaccgaccccgcctccatcgccgcccgcgggtacatcagcacccgggtgggcatgggggaggcggccgccatcttcatgacggccacgccgcccggctccgtggaggccttcccccagagcaacgcggtcatccaggacgaggagcgcgacatccccgagcggtcctggaacagcggctacgactggatcaccgacttccccgggaagaccgtgtggttcgtgccctccatcaagagcggcaacgacatcgccaactgcctccgcaagaacgggaagcgggtcatccagctgtcccgcaagacgttcgacaccgagtaccagaagaccaagaacaacgactgggactacgtggtgaccacggacatcagcgagatgggcgccaacttccgggccgaccgcgtcatcgacccccggcgctgcctgaagcccgtgatcctcaaggacgggcccgagcgggtgatcctggcgggcccgatgcccgtcaccgccgcctccgccgcccagcgccggggccgcatcgggcgcaaccagaacaaggagggcgaccagtacgtgtacatggggcagcccctgaacaacgacgaggaccacgcgcactggaccgaggccaagatgctcctggacaacatcaacacccccgagggcatcatcccggccctgttcgagcccgagcgggagaagtccgccgccatcgacggggagtaccgcctccggggcgaggcgcgcaagacgttcgtcgagctgatgcggcgcggcgacctgcccgtgtggctctcctacaaggtggccagcgaggggttccagtactccgaccggcgctggtgcttcgacggcgagcggaacaaccaggtcctggaggagaacatggacgtggagatctggaccaaggagggggagcgcaagaagctgcggccccgctggctcgacgcccggacctacagcgacccgctggccctgcgcgagttcaaggagttcgccgcgggccggcgcagcgtgtccggcgacctcatcctggagatcgggaagctgccccagcacctcaccctgcgggcccagaacgccctggacaacctcgtcatgctgcacaacagcgagcagggcgggaaggcctaccgccacgcgatggaggagctgcccgacaccatcgagacgctcatgctgctggccctcatcgccgtgctgaccggcggggtgaccctgttcttcctctccggcaagggcctggggaagaccagcatcggcctgctctgcgtcacggcctccagcgccctgctgtggatggcgtccgtggagccccactggatcgccgccagcatcatcctcgagttcttcctgatggtgctgctcatcccggagcccgaccggcagcgcacgccccaggacaaccagctggcctacgtcgtgatcgggctcctcttcatgatcctgaccgtggccgcgaacgagatgggcctgctcgagaccacgaagaaggacctggggatcggctacgtcgccgccgagaaccaccagcacgccaccatgctggacgtggacctccacccggcctccgcgtggaccctgtacgccgtggccaccacggtcatcacccccatgatgcggcacaccatcgagaacaccacggccaacatcagcctgaccgccatcgcgaaccaggccgccatcctcatgggcctggacaaggggtggcccatctccaagatggacatcggcgtgcccctgctcgccctggggtgctacagccaggtgaacccgctgaccctcaccgcggccgtcctgatgctggtggcccactacgccatcatcggccccgggctccaggccaaggcgacgcgcgaggcccagaagcgcaccgccgccggcatcatgaagaaccccaccgtggacggcatcgtcgccatcgacctggaccccgtggtgtacgacgcgaagttcgagaagcagctggggcagatcatgctcctgatcctgtgcacctcccagatcctcctgatgcggacgacctgggccctgtgcgagagcatcaccctcgccaccggcccgctgacgaccctgtgggaggggtcccccggcaagttctggaacaccaccatcgccgtcagcatggccaacatcttccgcggctcctacctcgcgggggccggcctggccttcagcctgatgaagtccctcgggggcgggcggcgcggcacgggcgcccagggggagaccctgggcgagaagtggaagcggcagctgaaccagctcagcaagagcgagttcaacacctacaagcgctccgggatcatggaggtggaccggagcgaggcgaaggagggcctgaagcgcggggagaccacgaagcacgccgtgtcccggggcaccgccaagctgcgctggttcgtcgagcggaacctcgtgaagcccgagggcaaggtgatcgacctggggtgcggccgcgggggctggagctactactgcgccgggctgaagaaggtcaccgaggtgaagggctacaccaagggcgggcccggccacgaggagccgatccccatggccacctacgggtggaacctggtgaagctccactccggcaaggacgtcttcttcatgccgcccgagaagtgcgacacgctgctgtgcgacatcggggagagctccccgaaccccaccatcgaggagggccggaccctccgcgtgctgaagatggtggagccctggctgcggggcaaccagttctgcatcaagatcctcaacccctacatgccgagcgtcgtggagaccctggagcgcatgcagcggaagcacgggggcatgctggtgcgcaaccccctctcccggaacagcacgcacgagatgtactgggtctcctgcgggaccggcaacatcgtgagcgcggtgaacatgacctcccgcatgctgctgaaccgcttcaccatggcccaccggaagcccacgtacgagcgcgacgtcgacctcggcgccgggacccggcacgtggccgtggagcccgaggtcgccaacctggacatcatcggccagcgcatcgagaacatcaagaacgagcacaagagcacctggcactacgacgaggacaacccgtacaagacctgggcgtaccacgggtcctacgaggtgaagcccagcggctccgccagctccatggtgaacggggtcgtgcggctgctcacgaagccctgggacgtcatccccatggtgacccagatcgccatgaccgacaccacgccgttcggccagcagcgcgtgttcaaggagaaggtcgacacccggacgccccgcgccaagcggggcaccacgcagatcatggaggtgaccgccaagtggctgtgggggttcctgagccgcaacaagaagccccggatctgcacccgcgaggagttcacccggaaggtgcgcagcaacgcggccatcggcgccgtcttcgtggacgagaaccagtggaactccgccaaggaggcggtggaggacgagcggttctgggacctcgtccaccgcgagcgggagctgcacaagcaggggaagtgcgccacgtgcgtgtacaacatgatgggcaagcgcgagaagaagctgggggagttcggcaaggccaagggcagccgggccatctggtacatgtggctcggggcccgcttcctggagttcgaggcgctgggcttcatgaacgaggaccactggttctcccgggagaacagcctctccggggtggagggcgaggggctgcacaagctgggctacatcctccgcgacatcagcaagatcccgggcgggaacatgtacgccgacgacaccgccggctgggacacccgcgtcaccgaggacgacctgcagaacgaggccaagatcacggacatcatggagcccgagcacgccctgctcgcgacctccatcttcaagctgacctaccagaacaaggtggtgcgggtccagcgccccgccaagaacgggaccgtgatggacgtgatcagccggcgcgaccagcggggctccggccaggtcgggacgtacggcctgaacaccttcaccaacatggaggtgcagctcatccgccagatggagagcgaggggatcttcctgccctccgagctggagaccccgaacctcgccgagcgggccctggactggctggagaagcacggcgccgagcgcctcaagcggatggcgatcagcggggacgactgcgtggtcaagcccatcgacgaccgcttcgccacggccctgaccgccctgaacgacatgggcaaggtgcggaaggacatcccccagtgggagccctccaagggctggaacgactggcagcaggtcccgttctgcagccaccacttccaccagctcatcatgaaggacgggcgcgagatcgtcgtgccctgccggaaccaggacgagctggtgggccgcgcccgggtctcccagggggcgggctggagcctgcgcgagaccgcctgcctcgggaagtcctacgcccagatgtggcagctgatgtacttccaccggcgcgacctgcggctcgccgcgaacgccatctgcagcgccgtgcccgtggactgggtccccaccagccgcaccacgtggtccatccacgcccaccaccagtggatgaccaccgaggacatgctgagcgtgtggaaccgcgtgtggatcgaggagaacccgtggatggaggacaagacccacgtctccagctgggaggaggtgccctacctgggcaagcgggaggaccagtggtgcggctccctcatcgggctgacggcccgcgcgacctgggccaccaacatccaggtggccatcaaccaggtccggcgcctgatcggcaacgagaactacctcgactacatgaccagcatgaagcggttcaagaacgagtccgacagcgagggggccctgtggtga

SEQ ID NO: 8189 - RNA, 9879 nt, synthetic construct
  misc_feature 1..9879: note = derived and/or modified CDS sequence (opt1) from DENV-1__KJ189362__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgggagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccctggtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaaggggatgacccagaacggccggctcatcacggccaacccgatcgtgaccgacaaggagaagcccgtcaacatcgagaccgagccgcccttcggggagagctacatcgtggtgggcgccggcgagaaggcgctgaagctgtcctggttcaagcgcgggagctccatcggcaagatgttcgaggccaccgcccgcggggcccgccgcatggccatcctcggcgacacggcgtgggacttcgggagcatcggcggcgtcttcacctccgtggggaagctggtgcaccagatcttcggcaccgcctacggggtcctgttcagcggcgtgtcctggaccatgaagatcgggatcggcatcctcctgacgtggctgggcctcaacagccggtccaccagcctgtccatgacctgcatcgccgtggggatggtcaccctgtacctcggcgtgatggtgcaggccgacagcgggtgcgtcatcaactggaagggccgcgagctgaagtgcgggtccggcatcttcgtgacgaacgaggtgcacacctggaccgagcagtacaagttccaggccgacagcccgaagcggctgagcgcggccatcggcaaggcctgggaggagggggtctgcggcatccgctccgccacccggctcgagaacatcatgtggaagcagatcagcaacgagctgaaccacatcctgctcgagaacgacatgaagttcaccgtggtggtcggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtggaggactacgggttcggcgtgttcaccacgaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacctgcacgtggcccaagagccacaccctctggtccaacggggtgctggagagcgagatgatcatccccaagatctacggcgggccgatctcccagcacaactaccggcccggctacttcacccagaccgccgggccctggcacctgggcaagctcgagctggacttcgacctgtgcgagggcacgaccgtcgtggtggacgagcactgcgggaaccgcggcccgagcctccggaccaccacggtcaccgggaagatcatccacgagtggtgctgccgctcctgcaccctgccgcccctgcggttccgcggcgaggacgggtgctggtacggcatggagatccggcccgtgaaggagaaggaggagaacctcgtgcgcagcatggtctccgccggcagcggggaggtggacagcttctccctgggcatcctgtgcgtgagcatcatgatcgaggaggtcatgcggtcccgctggagccgcaagatgctcatgaccgggacgctggccgtgttcctgctcctgatcatgggccagctgacctggaacgacctcatccggctgtgcatcatggtgggggccaacgcgtccgaccgcatgggcatgggcaccacctacctggccctcatggccacgttcaagatgcggccgatgttcgccgtcgggctgctgttccgccggctcaccagccgcgaggtgctgctgctcaccatcggcctgtccctggtggccagcgtcgagctccccaactccctggaggagctgggggacggcctcgcgatgggcatcatgatgctgaagctgctcaccgagttccagccccaccagctgtggacgaccctgctcagcctgaccttcgtgcggaccacgctgtccctcgactacgcctggaagaccaccgccatggccctgagcatcgtctccctgttccccctctgcctgagcaccacgtcccagaagaccacctggctgccggtgctcctggggagcttcggctgcaagcccctgaccatgttcctcatcaccgagaacaagatctgggggcgcaagtcctggcccctgaacgagggcatcatggcgatcgggatcgtgagcatcctgctctccagcctgctgaagaacgacgtccccctcgccggcccgctgatcgccggcgggatgctgatcgcctgctacgtgatcagcggctccagcgccgacctctccctggagaaggcggccgaggtgagctgggagcaggaggccgagcactccggggccagccactccatcctggtcgaggtgcaggacgacggcacgatgaagatcaaggacgaggagcgggacgacaccctcaccatcctgctgaaggccaccctcctggcggtgagcggggtctaccccatgtccatccccgccacgctgttcgtgtggtacttctggcagaagaagaagcagcgcagcggcgtgctctgggacaccccctccccgcccgaggtcgagcgggccgtgctggacaacggcatctaccgcatcctgcagcgggggctgctcggccgcagccaggtgggggtcggcgtgttccaggacggggtgttccacaccatgtggcacgtcacccggggcgccgtgctgatgtaccagggcaagcgcctggagccctcctgggccagcgtgaagaaggacctcatctcctacgggggcgggtggcggttccagggcagctggaacacgggggaggaggtccaggtgatcgcggtggagcccggcaagaacccgaagaacgtccagaccacccccggcaccttcaagacgcccgagggggaggtgggcgccatcgccctggacttcaagcccgggacctccggcagcccgatcgtgaaccgcgagggcaagatcgtcgggctgtacggcaacggggtggtgaccacctccggcacgtacgtcagcgccatcgcccaggcgaaggccagccaggaggggcccctccccgagatcgaggacgaggtgttcaagaagcggaacctgaccatcatggacctgcacccgggctccggcaagacccgccggtacctccccgccatcgtgcgcgaggccatcaagcgcaagctgcggaccctgatcctcgcgcccacgcgcgtcgtggccagcgagatggccgaggccctgaaggggatgcccatccggtaccagaccaccgccgtgaagtccgagcacaccggccgcgagatcgtcgacctgatgtgccacgcgacgttcaccatgcggctcctgagcccggtgcgcgtgcccaactacaacatgatcatcatggacgaggcccacttcaccgaccccgcctccatcgccgcccgggggtacatcagcacccgcgtcggcatgggggaggcggccgccatcttcatgacggccacgccgcccggctccgtggaggccttcccccagagcaacgcggtgatccaggacgaggagcgggacatccccgagcgctcctggaacagcggctacgactggatcaccgacttccccgggaagaccgtctggttcgtgccctccatcaagagcggcaacgacatcgccaactgcctgcggaagaacgggaagcgcgtgatccagctctcccggaagacgttcgacaccgagtaccagaagaccaagaacaacgactgggactacgtcgtgaccacggacatcagcgagatgggcgccaacttccgcgccgaccgggtgatcgacccccgccggtgcctgaagcccgtcatcctgaaggacgggcccgagcgcgtgatcctcgcgggcccgatgcccgtgaccgccgcctccgccgcccagcggcgcggccgcatcgggcggaaccagaacaaggagggcgaccagtacgtctacatggggcagcccctgaacaacgacgaggaccacgcgcactggaccgaggccaagatgctgctcgacaacatcaacacccccgagggcatcatcccggccctgttcgagcccgagcgcgagaagtccgccgccatcgacggggagtaccggctgcgcggcgaggcgcggaagacgttcgtggagctcatgcgccggggcgacctgcccgtctggctgtcctacaaggtggccagcgaggggttccagtactccgaccgccggtggtgcttcgacggcgagcgcaacaaccaggtgctcgaggagaacatggacgtcgagatctggaccaaggagggggagcggaagaagctgcgcccccggtggctggacgcccgcacctacagcgacccgctcgccctgcgggagttcaaggagttcgccgcgggccgccggagcgtgtccggcgacctgatcctcgagatcgggaagctgccccagcacctgaccctccgcgcccagaacgccctggacaacctggtgatgctccacaacagcgagcagggcgggaaggcctaccggcacgcgatggaggagctgcccgacaccatcgagacgctgatgctcctggccctgatcgccgtcctcaccggcggggtgaccctgttcttcctgtccggcaagggcctcgggaagaccagcatcggcctgctgtgcgtgacggcctccagcgtcctcctgtggatggcctccgtggagccccactggatcgcggccagcatcatcctggagttcttcctcatggtgctgctgatcccggagcccgaccgccagcggacgccccaggacaaccagctcgcctacgtcgtgatcgggctgctgttcatgatcctcaccgtggccgccaacgagatgggcctgctggagaccacgaagaaggacctcgggatcggctacgtcgcggccgagaaccaccagcacgccaccatgctggacgtggacctgcacccggcctccgcctggaccctctacgcggtggccaccacggtcatcacccccatgatgcgccacaccatcgagaacaccacggccaacatcagcctgaccgccatcgccaaccaggcggccatcctgatgggcctcgacaaggggtggcccatctccaagatggacatcggcgtgcccctgctggccctcgggtgctacagccaggtgaacccgctgaccctgaccgccgcggtcctcatgctggtggcccactacgccatcatcggccccgggctgcaggccaaggccacgcgcgaggcgcagaagcggaccgccgccggcatcatgaagaaccccaccgtggacggcatcgtcgccatcgacctcgaccccgtggtgtacgacgccaagttcgagaagcagctggggcagatcatgctgctcatcctgtgcacctcccagatcctgctcatgcgcacgacctgggcgctgtgcgagagcatcaccctggccaccggcccgctcacgaccctgtgggaggggtcccccggcaagttctggaacaccaccatcgccgtcagcatggccaacatcttccggggctcctacctggccggggcgggcctcgccttcagcctgatgaagtccctcgggggcgggcgccgggggacgggcgcccagggggagaccctcggcgagaagtggaagcgccagctgaaccagctgagcaagagcgagttcaacacctacaagcggtccgggatcatggaggtggaccgcagcgaggccaaggagggcctcaagcgcggggagaccacgaagcacgcggtgtcccgcggcaccgccaagctgcggtggttcgtcgagcgcaacctggtgaagcccgagggcaaggtgatcgacctggggtgcggccgcgggggctggagctactactgcgccgggctcaagaaggtcaccgaggtgaagggctacaccaagggcgggcccggccacgaggagccgatccccatggccacctacgggtggaacctggtgaagctgcactccggcaaggacgtcttcttcatgccgcccgagaagtgcgacacgctcctgtgcgacatcggggagagctccccgaaccccaccatcgaggagggccgcaccctgcgggtgctcaagatggtggagccctggctgcgcggcaaccagttctgcatcaagatcctgaacccctacatgccgagcgtcgtggagaccctcgagcggatgcagcgcaagcacgggggcatgctggtgcggaaccccctgtcccgcaacagcacgcacgagatgtactgggtctcctgcgggaccggcaacatcgtgagcgccgtgaacatgacctcccgcatgctcctgaaccggttcaccatggcgcaccgcaagcccacgtacgagcgggacgtcgacctgggcgccgggacccgccacgtggccgtggagcccgaggtcgccaacctcgacatcatcggccagcggatcgagaacatcaagaacgagcacaagagcacctggcactacgacgaggacaacccgtacaagacctgggcctaccacgggtcctacgaggtgaagcccagcggctccgcgagctccatggtgaacggggtcgtgcgcctgctgacgaagccctgggacgtcatccccatggtgacccagatcgccatgaccgacaccacgccgttcggccagcagcgggtgttcaaggagaaggtcgacacccgcacgccccgggccaagcgcggcaccacgcagatcatggaggtgaccgccaagtggctctgggggttcctgagccggaacaagaagccccgcatctgcacccgggaggagttcacccgcaaggtgcggagcaacgccgcgatcggcgccgtcttcgtggacgagaaccagtggaactccgccaaggaggccgtggaggacgagcgcttctgggacctggtccaccgggagcgcgagctccacaagcaggggaagtgcgcgacgtgcgtgtacaacatgatgggcaagcgggagaagaagctgggggagttcggcaaggccaagggcagccgcgccatctggtacatgtggctgggggcccggttcctcgagttcgaggccctgggcttcatgaacgaggaccactggttctcccgcgagaacagcctgtccggggtggagggcgaggggctccacaagctgggctacatcctgcgcgacatcagcaagatcccgggcgggaacatgtacgcggacgacaccgccggctgggacacccgggtcaccgaggacgacctccagaacgaggccaagatcacggacatcatggagcccgagcacgccctgctggccacctccatcttcaagctcacctaccagaacaaggtggtgcgcgtccagcggcccgcgaagaacgggaccgtgatggacgtgatcagccgccgggaccagcgcggctccggccaggtcgggacgtacggcctgaacaccttcaccaacatggaggtgcagctgatccggcagatggagagcgaggggatcttcctcccctccgagctggagaccccgaacctggccgagcgcgccctcgactggctggagaagcacggcgccgagcggctgaagcgcatggccatcagcggggacgactgcgtggtcaagcccatcgacgaccggttcgcgacggccctcaccgccctgaacgacatgggcaaggtgcgcaaggacatcccccagtgggagccctccaagggctggaacgactggcagcaggtcccgttctgcagccaccacttccaccagctgatcatgaaggacgggcgggagatcgtcgtgccctgccgcaaccaggacgagctcgtgggccgggcccgcgtctcccagggggccggctggagcctgcgggagaccgcgtgcctggggaagtcctacgcccagatgtggcagctcatgtacttccaccgccgggacctgcgcctggccgccaacgcgatctgcagcgccgtgcccgtggactgggtccccaccagccgcaccacgtggtccatccacgcccaccaccagtggatgaccaccgaggacatgctcagcgtgtggaaccgggtgtggatcgaggagaacccgtggatggagaacaagacccacgtctccagctgggaggaggtgccctacctgggcaagcgcgaggaccagtggtgcggctccctgatcgggctcacggcccgggccacctgggcgaccaacatccaggtggccatcaaccaggtccgccggctgatcggcaacgagaactacctggactacatgaccagcatgaagcgcttcaagaacgagtccgacagcgagggggccctctggtga

SEQ ID NO: 8190 - RNA, 9879 nt, synthetic construct
  misc_feature 1..9879: note = derived and/or modified CDS sequence (opt1) from DENV-1__KJ189363__SS-prME
  source 1..9879: mol_type = other RNA
agcgtgaccatgctgctcatgctgctgcccaccgccctcgccttccacctgacgacccgcggcggggagccgcacatgatcgtctccaagcaggagcggggcaagagcctgctcttcaagacctccgcgggggtgaacatgtgcaccctgatcgccatggacctgggcgagctctgcgaggacacgatgacctacaagtgcccccgcatcaccgaggccgagcccgacgacgtggactgctggtgcaacgccaccgacacgtgggtcacctacgggacctgcagccagaccggcgagcaccggcgcgagaagcggtccgtggccctggcgccccacgtgggcctggggctcgagacgcgcaccgagacctggatgagctccgagggcgcctggaagcagatccagcgggtcgagacctgggccctgcgccacccggggttcatggtgatcgccttcttcctggcgcacgccatcggcacgagcatcacccagaaggggatcatcttcatcctcctgatgctggtgaccccctccatggccatgcggtgcgtcggcatcggcaaccgcgacttcgtggaggggctcagcggcgccacctgggtggacgtcgtgctggagcacgggtcctgcgtgacgaccatggccaagaacaagcccaccctggacatcgagctcctgaagaccgaggtcacgaaccccgcggtgctgcggaagctctgcatcgaggccaagatcagcaacaccaccaccgactcccgctgcccgacgcagggcgaggccaccctggtggaggagcaggacgccaacttcgtctgccggcgcaccttcgtggaccggggctgggggaacggctgcgggctgttcggcaaggggagcctcctgacctgcgccaagttcaagtgcgtgacgaagctggagggcaagatcgtccagtacgagaacctcaagtactccgtgatcgtgaccgtccacaccggcgaccagcaccaggtggggaacgagaccacggagcacggcaccatcgcgaccatcaccccccaggcccccaccagcgagatccagctgacggactacggggccctgaccctcgactgctccccccgcaccggcctggacttcaacgagatggtcctgctcaccatgaaggagaagagctggctggtgcacaagcagtggttcctggacctcccgctgccctggacgtccggggccagcaccagccaggagacctggaaccggcaggacctgctcgtgaccttcaagacggcccacgcgaagaagcaggaggtcgtggtgctgggctcccaggagggcgccatgcacaccgccctgaccggggccaccgagatccagacgagcggcaccaccaccatcttcgccgggcacctcaagtgccgcctgaagatggacaagctgacgctcaagggcatgtcctacgtcatgtgcaccgggagcttcaagctggagaaggaggtggcggagacccagcacggcaccgtgctggtccaggtgaagtacgagggcacggacgccccctgcaagatccccttctccacccaggacgagaagggggtgacccagaacggccggctgatcaccgccaacccgatcgtcacggacaaggagaagcccgtgaacatcgagaccgagccccccttcggggagagctacatcgtggtcggcgccggcgagaaggcgctcaagctgtcctggttcaagcgcgggagctccatcggcaagatgttcgaggccaccgcccggggggcccgccgcatggccatcctgggcgacaccgcgtgggacttcgggagcatcggcggcgtgttcacgtccgtggggaagctcgtccaccagatcttcggcaccgcctacggggtgctgttcagcggcgtgtcctggaccatgaagatcgggatcggcatcctgctcacctggctgggcctgaacagccggtccacgagcctctccatgacctgcatcgccgtcgggatggtgaccctgtacctgggcgtgatggtccaggccgacagcgggtgcgtgatcaactggaagggccgcgagctcaagtgcgggtccggcatcttcgtgaccaacgaggtccacacgtggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtggtcgtgggggacgccaacggcatcctcgcgcaggggaagaagatgatccgcccccagcccatggagcacaagtactcctggaagagctggggcaaggccaagatcatcggcgccgacatccagaacaccacgttcatcatcgacgggcccgacaccccggagtgccccgacggccagcgggcctggaacatctgggaggtggaggactacgggttcggcgtcttcaccaccaacatctggctgaagctgcgcgactcctacacgcagatgtgcgaccaccggctcatgagcgcggccatcaaggactccaaggccgtgcacgccgacatgggctactggatcgagagcgagaagaacgagacctggaagctggcccgcgcgtccttcatcgaggtgaagacctgcacctggcccaagagccacacgctgtggtccaacggggtcctcgagagcgagatgatcatccccaagatctacggcgggccgatctcccagcacaactaccggcccggctacttcacccagaccgccgggccctggcacctgggcaagctggagctcgacttcgacctgtgcgagggcaccacggtggtggtcgacgagcactgcgggaaccgcggcccgagcctgcggaccaccaccgtgacggggaagatcatccacgagtggtgctgccgctcctgcaccctcccccccctgcggttccgcggcgaggacgggtgctggtacggcatggagatccggcccgtgaaggagaaggaggagaacctggtccgcagcatggtgtccgccggcagcggggaggtggacagcttctccctcggcatcctgtgcgtcagcatcatgatcgaggaggtgatgcggtcccgctggagccgcaagatgctgatgaccgggaccctcgccgtgttcctgctgctcatcatgggccagctgacgtggaacgacctgatccggctctgcatcatggtcggggccaacgcgtccgaccgcatgggcatgggcaccacctacctggccctgatggccaccttcaagatgcggccgatgttcgccgtggggctcctgttccgccggctgacgagccgcgaggtgctcctgctgaccatcggcctctccctggtcgccagcgtggagctgcccaactccctcgaggagctgggggacggcctggcgatgggcatcatgatgctcaagctgctgaccgagttccagccccaccagctctggaccacgctgctgagcctcaccttcgtcaagaccaccctgtccctggactacgcctggaagacgaccgccatggccctcagcatcgtgtccctgttccccctgtgcctcagcaccacctcccagaagacgacctggctgccggtgctgctcgggagcttcggctgcaagcccctgaccatgttcctgatcaccgagaacaagatctgggggcggaagtcctggcccctcaacgagggcatcatggcgatcgggatcgtcagcatcctgctgtccagcctcctgaagaacgacgtgcccctggccggcccgctcatcgccggcgggatgctgatcgcctgctacgtgatcagcggctccagcgccgacctgtccctcgagaaggcggccgaggtcagctgggagcaggaggccgagcactccggggccagccactccatcctggtggaggtgcaggacgacggcaccatgaagatcaaggacgaggagcgcgacgacacgctgaccatcctcctgaaggccaccctgctcgcggtcagcggggtgtaccccatgtccatccccgccaccctgttcgtgtggtacttctggcagaagaagaagcagcggagcggcgtcctgtgggacacgccctccccgcccgaggtggagcgcgccgtgctcgacaacggcatctaccggatcctgcagcgcgggctgctgggccggagccaggtcggggtgggcgtgttccaggacggggtcttccacaccatgtggcacgtgacccgcggcgccgtgctcatgtaccagggcaagcggctggagccctcctgggccagcgtcaagaaggacctgatctcctacgggggcgggtggcgcttccagggcagctggaacaccggggaggaggtgcaggtgatcgcggtcgagcccggcaagaacccgaagaacgtgcagacgacccccggcaccttcaagacccccgagggggaggtgggcgccatcgccctcgacttcaagcccgggacgtccggcagcccgatcgtcaaccgggagggcaagatcgtggggctgtacggcaacggggtggtcaccacctccggcacctacgtgagcgccatcgcccaggcgaaggccagccaggaggggcccctgcccgagatcgaggacgaggtgttcaagaagcgcaacctcacgatcatggacctgcacccgggctccggcaagacccggcgctacctgcccgccatcgtccgggaggccatcaagcgcaagctccgcaccctgatcctggcgcccacccgggtggtggccagcgagatggccgaggccctcaaggggatgcccatccgctaccagacgaccgccgtcaagtccgagcacaccggccgggagatcgtggacctgatgtgccacgcgaccttcacgatgcgcctgctcagcccggtgcgggtccccaactacaacatgatcatcatggacgaggcccacttcaccgaccccgcctccatcgccgcccgcgggtacatcagcacccgggtgggcatgggggaggcggccgccatcttcatgaccgccacgcccccgggctccgtggaggccttcccccagagcaacgcggtcatccaggacgaggagcgcgacatccccgagcggtcctggaacagcggctacgactggatcaccgacttccccgggaagaccgtgtggttcgtgccgtccatcaagagcggcaacgacatcgccaactgcctgcgcaagaacgggaagcgggtcatccagctgtcccgcaagaccttcgacacggagtaccagaagaccaagaacaacgactgggactacgtggtgaccaccgacatcagcgagatgggcgccaacttccgggccgaccgcgtcatcgacccccggcgctgcctcaagcccgtgatcctgaaggacgggcccgagcgggtgatcctggcgggcccgatgcccgtcacggccgcctccgccgcccagcgccggggccgcatcgggcgcaaccagaacaaggagggcgaccagtacgtgtacatggggcagcccctcaacaacgacgaggaccacgcgcactggaccgaggccaagatgctgctggacaacatcaacacccccgagggcatcatcccggccctcttcgagcccgagcgggagaagagcgccgccatcgacggggagtaccgcctgcggggcgaggcgcgcaagaccttcgtcgagctgatgcggcgcggcgacctccccgtgtggctgtcctacaaggtggccagcgaggggttccagtactccgaccggcgctggtgcttcgacggcgagcggaacaaccaggtcctggaggagaacatggacgtggagatctggacgaaggagggggagcgcaagaagctccggccccgctggctggacgcccggacctacagcgacccgctggccctccgcgagttcaaggagttcgccgcgggccggcgcagcgtgtccggcgacctgatcctggagatcgggaagctcccccagcacctgaccctgcgggcccagaacgccctcgacaacctggtcatgctgcacaacagcgagcagggcgggaaggcctaccgccacgcgatggaggagctccccgacaccatcgagaccctgatgctgctcgccctgatcgccgtgctgacgggcggggtgaccctcttcttcctgtccggcaagggcctggggaagaccagcatcggcctcctgtgcgtcaccgcctccagcgccctgctctggatggcgtccgtggagccccactggatcgccgccagcatcatcctggagttcttcctgatggtgctcctgatcccggagcccgaccggcagcgcacgccccaggacaaccagctggcctacgtcgtgatcgggctcctgttcatgatcctgaccgtggccgcgaacgagatgggcctcctggagaccaccaagaaggacctggggatcggctacgtcgccgccgagaaccaccagcacgccacgatgctcgacgtggacctgcacccggcctccgcgtggaccctgtacgccgtggccaccaccgtcatcacgcccatgatgcggcacaccatcgagaacaccaccgccaacatcagcctcacggccatcgcgaaccaggccgccatcctgatgggcctggacaaggggtggcccatctccaagatggacatcggcgtgcccctcctggccctggggtgctacagccaggtgaacccgctcaccctgaccgcggccgtcctgatgctcgtggcccactacgccatcatcggccccgggctgcaggccaaggcgacccgcgaggcccagaagcgcacggccgccggcatcatgaagaaccccaccgtggacggcatcgtcgccatcgacctggaccccgtggtgtacgacgcgaagttcgagaagcagctcgggcagatcatgctgctgatcctctgcacctcccagatcctgctgatgcggaccacgtgggccctctgcgagagcatcaccctggccaccggcccgctgaccacgctctgggaggggtcccccggcaagttctggaacaccaccatcgccgtcagcatggccaacatcttccgcggctcctacctggcgggggccggcctggccttcagcctcatgaagtccctggggggcgggcggcgcggcaccggcgcccagggggagacgctgggcgagaagtggaagcggcagctcaaccagctgagcaagagcgagttcaacacctacaagcgctccgggatcatggaggtggaccggagcgaggcgaaggagggcctgaagcgcggggagaccaccaagcacgccgtgtcccggggcacggccaagctccgctggttcgtcgagcggaacctggtgaagcccgagggcaaggtgatcgacctggggtgcggccgcgggggctggagctactactgcgccgggctgaagaaggtcaccgaggtgaagggctacaccaagggcgggcccggccacgaggagccgatccccatggccacctacgggtggaacctcgtgaagctgcactccggcaaggacgtcttcttcatgccccccgagaagtgcgacaccctgctctgcgacatcggggagagctccccgaaccccacgatcgaggagggccggaccctgcgcgtgctgaagatggtggagccctggctccggggcaaccagttctgcatcaagatcctgaacccctacatgccgagcgtcgtggagaccctggagcgcatgcagcggaagcacgggggcatgctcgtgcgcaaccccctgtcccggaacagcacccacgagatgtactgggtctcctgcgggacgggcaacatcgtgagcgcggtgaacatgacctcccgcatgctgctcaaccgcttcaccatggcccaccggaagcccacctacgagcgcgacgtcgacctgggcgccgggacgcggcacgtggccgtggagcccgaggtcgccaacctggacatcatcggccagcgcatcgagaacatcaagaacgagcacaagagcacctggcactacgacgaggacaacccgtacaagacctgggcgtaccacgggtcctacgaggtgaagcccagcggctccgccagctccatggtgaacggggtcgtgcggctcctgaccaagccctgggacgtcatccccatggtgacgcagatcgccatgaccgacaccaccccgttcggccagcagcgcgtgttcaaggagaaggtcgacacgcggaccccccgcgccaagcggggcaccacccagatcatggaggtgacggccaagtggctgtgggggttcctcagccgcaacaagaagccccggatctgcacccgcgaggagttcacccggaaggtgcgcagcaacgcggccatcggcgccgtcttcgtggacgagaaccagtggaactccgccaaggaggcggtggaggacgagcggttctgggacctggtccaccgcgagcgggagctgcacaagcaggggaagtgcgccacctgcgtgtacaacatgatgggcaagcgcgagaagaagctcggggagttcggcaaggccaagggcagccgggccatctggtacatgtggctgggggcccgcttcctggagttcgaggcgctcggcttcatgaacgaggaccactggttctcccgggagaacagcctgtccggggtggagggcgaggggctgcacaagctcggctacatcctgcgcgacatcagcaagatcccgggcgggaacatgtacgccgacgacacggccggctgggacacccgcgtcaccgaggacgacctgcagaacgaggccaagatcaccgacatcatggagcccgagcacgccctcctggcgacgtccatcttcaagctgacctaccagaacaaggtggtgcgggtccagcgccccgccaagaacgggaccgtgatggacgtgatcagccggcgcgaccagcggggctccggccaggtcgggacctacggcctcaacacgttcaccaacatggaggtgcagctgatccgccagatggagagcgaggggatcttcctgccctccgagctcgagaccccgaacctggccgagcgggccctggactggctcgagaagcacggcgccgagcgcctgaagcggatggcgatcagcggggacgactgcgtggtcaagcccatcgacgaccgcttcgccaccgccctgacggccctcaacgacatgggcaaggtgcggaaggacatcccccagtgggagccctccaagggctggaacgactggcagcaggtgccgttctgcagccaccacttccaccagctgatcatgaaggacgggcgcgagatcgtcgtgccctgccggaaccaggacgagctggtgggccgcgcccgggtctcccagggggcgggctggagcctccgcgagaccgcctgcctggggaagtcctacgcccagatgtggcagctgatgtacttccaccggcgcgacctccggctggccgcgaacgccatctgcagcgccgtgcccgtggactgggtccccaccagccgcaccacctggtccatccacgcccaccaccagtggatgacgaccgaggacatgctgagcgtgtggaaccgcgtgtggatcgaggagaacccgtggatggagaacaagacccacgtctccagctgggaggaggtgccctacctcggcaagcgggaggaccagtggtgcggctccctgatcgggctgaccgcccgcgcgacgtgggccaccaacatccaggtggccatcaaccaggtccggcgcctcatcggcaacgagaactacctggactacatgaccagcatgaagcggttcaagaacgagtccgacagcgagggggccctgtggtga

SEQ ID NO: 8191 - RNA, 9879 nt, synthetic construct
  misc_feature 1..9879: note = derived and/or modified CDS sequence (opt1) from DENV-1__KJ189364__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgggagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaaggggatgacccagaacggccggctgatcacggccaacccgatcgtgaccgacaaggagaagcccgtcaacatcgagaccgagccgcccttcggggagagctacatcgtggtgggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtcttcacctccgtggggaagctcgtgcaccagatcttcggcaccgcctacggggtcctgttcagcggcgtgtcctggaccatgaagatcgggatcggcatcctgctcacgtggctgggcctgaacagccggtccaccagcctctccatgacctgcatcgccgtggggatggtcaccctgtacctgggcgtgatggtgcaggccgacagcgggtgcgtcatcaactggaagggccgcgagctcaagtgcgggtccggcatcttcgtgacgaacgaggtgcacacctggaccgagcagtacaagttccaggccgacagcccgaagcggctgagcgcggccatcggcaaggcctgggaggagggggtctgcggcatccgctccgccacccggctggagaacatcatgtggaagcagatcagcaacgagctcaaccacatcctgctggagaacgacatgaagttcaccgtggtggtcggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtggaggactacgggttcggcgtgttcaccacgaacatctggctgaagctgcgcgactcctacacccagatgtgcgaccaccggctcatgagcgcggccatcaaggactccaaggccgtccacgccgacatgggctactggatcgagagcgagaagaacgagacctggaagctggcccgcgcgtccttcatcgaggtgaagacctgcacgtggcccaagagccacaccctgtggtccaacggggtgctcgagagcgagatgatcatccccaagatctacggcgggccgatctcccagcacaactaccggcccggctacttcacccagaccgccgggccctggcacctgggcaagctggagctcgacttcgacctgtgcgagggcacgaccgtcgtggtggacgagcactgcgggaaccgcggcccgagcctgcggaccaccacggtcaccgggaagatcatccacgagtggtgctgccgctcctgcaccctgccgcccctgcggttccgcggcgaggacgggtgctggtacggcatggagatccggcccgtgaaggagaaggaggagaacctggtgcgcagcatggtctccgccggcagcggggaggtggacagcttctccctcggcatcctgtgcgtgagcatcatgatcgaggaggtcatgcggtcccgctggagccgcaagatgctgatgaccgggacgctcgccgtgttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtcgggctcctgttccgccggctgaccagccgcgaggtgctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgcggaccacgctgtccctggactacgcctggaagaccaccgccatggccctcagcatcgtctccctgttccccctgtgcctcagcaccacgtcccagaagaccacctggctgccggtgctgctcgggagcttcggctgcaagcccctgaccatgttcctgatcaccgagaacaagatctgggggcgcaagtcctggcccctcaacgagggcatcatggcgatcgggatcgtgagcatcctgctgtccagcctcctgaagaacgacgtccccctggccggcccgctcatcgccggcgggatgctgatcgcctgctacgtgatcagcggctccagcgccgacctgtccctcgagaaggcggccgaggtgagctgggagcaggaggccgagcactccggggccagccactccatcctggtcgaggtgcaggacgacggcacgatgaagatcaaggacgaggagcgggacgacaccctgaccatcctcctgaaggccaccctgctcgcggtgagcggggtctaccccatgtccatccccgccacgctgttcgtgtggtacttctggcagaagaagaagcagcgcagcggcgtgctgtgggacaccccctccccgcccgaggtcgagcgggccgtgctcgacaacggcatctaccgcatcctgcagcgggggctgctgggccgcagccaggtgggggtcggcgtgttccaggacggggtgttccacaccatgtggcacgtcacccggggcgccgtgctcatgtaccagggcaagcgcctggagccctcctgggccagcgtgaagaaggacctgatctcctacgggggcgggtggcggttccagggcagctggaacacgggggaggaggtccaggtgatcgcggtggagcccggcaagaacccgaagaacgtccagaccacccccggcaccttcaagacgcccgagggggaggtgggcgccatcgccctcgacttcaagcccgggacctccggcagcccgatcgtgaaccgcgagggcaagatcgtcgggctgtacggcaacggggtggtgaccacctccggcacgtacgtcagcgccatcgcccaggcgaaggccagccaggaggggcccctgcccgagatcgaggacgaggtgttcaagaagcggaacctcaccatcatggacctgcacccgggctccggcaagacccgccggtacctgcccgccatcgtgcgcgaggccatcaagcgcaagctccggaccctgatcctggcgcccacgcgcgtcgtggccagcgagatggccgaggccctcaaggggatgcccatccggtaccagaccaccgccgtgaagtccgagcacaccggccgcgagatcgtcgacctgatgtgccacgcgacgttcaccatgcggctgctcagcccggtgcgcgtgcccaactacaacatgatcatcatggacgaggcccacttcaccgaccccgcctccatcgccgcccgggggtacatcagcacccgcgtcggcatgggggaggcggccgccatcttcatgacggccacgccgcccggctccgtggaggccttcccccagagcaacgcggtgatccaggacgaggagcgggacatccccgagcgctcctggaacagcggctacgactggatcaccgacttccccgggaagaccgtctggttcgtgccctccatcaagagcggcaacgacatcgccaactgcctgcggaagaacgggaagcgcgtgatccagctgtcccggaagacgttcgacaccgagtaccagaagaccaagaacaacgactgggactacgtcgtgaccacggacatcagcgagatgggcgccaacttccgcgccgaccgggtgatcgacccccgccggtgcctcaagcccgtcatcctgaaggacgggcccgagcgcgtgatcctggcgggcccgatgcccgtgaccgccgcctccgccgcccagcggcgcggccgcatcgggcggaaccagaacaaggagggcgaccagtacgtctacatggggcagcccctcaacaacgacgaggaccacgcgcactggaccgaggccaagatgctgctggacaacatcaacacccccgagggcatcatcccggccctcttcgagcccgagcgcgagaagtccgccgccatcgacggggagtaccggctgcgcggcgaggcgcggaagacgttcgtggagctgatgcgccggggcgacctccccgtctggctgtcctacaaggtggccagcgaggggttccagtactccgaccgccggtggtgcttcgacggcgagcgcaacaaccaggtgctggaggagaacatggacgtcgagatctggaccaaggagggggagcggaagaagctccgcccccggtggctggacgcccgcacctacagcgacccgctggccctccgggagttcaaggagttcgccgcgggccgccggagcgtgtccggcgacctgatcctggagatcgggaagctcccccagcacctgaccctgcgcgcccagaacgccctcgacaacctggtgatgctgcacaacagcgagcagggcgggaaggcctaccggcacgcgatggaggagctccccgacaccatcgagacgctgatgctgctcgccctgatcgccgtcctgaccggcggggtgaccctcttcttcctgtccggcaagggcctggggaagaccagcatcggcctcctgtgcgtgacggcctccagcgccctgctctggatggcgtccgtcgagccccactggatcgccgccagcatcatcctggagttcttcctgatggtgctcctgatcccggagcccgaccgccagcggacgccccaggacaaccagctggcctacgtggtcatcgggctcctgttcatgatcctgaccgtggccgcgaacgagatgggcctcctggagaccacgaagaaggacctggggatcggctacgtggccgccgagaaccaccagcacgccaccatgctcgacgtcgacctgcacccggcctccgcgtggaccctgtacgccgtggccaccacggtgatcacccccatgatgcgccacaccatcgagaacaccacggccaacatcagcctcaccgccatcgcgaaccaggccgccatcctgatgggcctggacaaggggtggcccatctccaagatggacatcggcgtccccctcctggccctggggtgctacagccaggtgaacccgctcaccctgaccgcggccgtgctgatgctcgtcgcccactacgccatcatcggccccgggctgcaggccaaggcgacgcgcgaggcccagaagcggaccgccgccggcatcatgaagaaccccaccgtggacggcatcgtggccatcgacctggaccccgtcgtgtacgacgcgaagttcgagaagcagctcgggcagatcatgctgctgatcctctgcacctcccagatcctgctgatgcgcacgacctgggccctctgcgagagcatcaccctggccaccggcccgctgacgaccctctgggaggggtcccccggcaagttctggaacaccaccatcgccgtgagcatggccaacatcttccggggctcctacctggcgggggccggcctggccttcagcctcatgaagtccctcgggggcgggcgccggggcacgggcgcccagggggagaccctgggcgagaagtggaagcgccagctcaaccagctgagcaagagcgagttcaacacctacaagcggtccgggatcatggaggtcgaccgcagcgaggcgaaggagggcctgaagcgcggggagaccacgaagcacgccgtgtcccgcggcaccgccaagctccggtggttcgtggagcgcaacctggtcaagcccgagggcaaggtgatcgacctggggtgcggccgcgggggctggagctactactgcgccgggctgaagaaggtgaccgaggtcaagggctacaccaagggcgggcccggccacgaggagccgatccccatggccacctacgggtggaacctcgtgaagctgcactccggcaaggacgtgttcttcatgccgcccgagaagtgcgacacgctgctctgcgacatcggggagagctccccgaaccccaccatcgaggagggccgcaccctgcgggtcctgaagatggtggagccctggctccgcggcaaccagttctgcatcaagatcctgaacccctacatgccgagcgtggtcgagaccctggagcggatgcagcgcaagcacgggggcatgctcgtgcggaaccccctgtcccgcaacagcacgcacgagatgtactgggtgtcctgcgggaccggcaacatcgtcagcgcggtgaacatgacctcccgcatgctgctcaaccggttcaccatggcccaccgcaagcccacgtacgagcgggacgtggacctgggcgccgggacccgccacgtcgccgtggagcccgaggtggccaacctggacatcatcggccagcggatcgagaacatcaagaacgagcacaagagcacctggcactacgacgaggacaacccgtacaagacctgggcgtaccacgggtcctacgaggtcaagcccagcggctccgccagctccatggtgaacggggtggtccgcctcctgacgaagccctgggacgtgatccccatggtcacccagatcgccatgaccgacaccacgccgttcggccagcagcgggtgttcaaggagaaggtggacacccgcacgccccgggccaagcgcggcaccacgcagatcatggaggtcaccgccaagtggctgtggagcttcctcagccggaacaagaagccccgcatctgcacccgggaggagttcacccgcaaggtgcggtccaacgcggccatcggggccgtgttcgtcgacgagaaccagtggaacagcgccaaggaggcggtggaggacgagcgcttctgggacctggtgcaccgggagcgcgagctgcacaagcagggcaagtgcgccacgtgcgtctacaacatgatggggaagcgggagaagaagctcggcgagttcgggaaggccaagggctcccgcgccatctggtacatgtggctgggcgcccggttcctggagttcgaggcgctcgggttcatgaacgaggaccactggttcagccgcgagaactccctgagcggcgtggagggggagggcctgcacaagctcgggtacatcctgcgcgacatctccaagatcccgggcggcaacatgtacgccgacgacaccgccgggtgggacacccgggtgaccgaggacgacctgcagaacgaggccaagatcacggacatcatggagcccgagcacgccctcctggcgaccagcatcttcaagctgacctaccagaacaaggtcgtgcgcgtgcagcggcccgccaagaacggcaccgtcatggacgtgatctcccgccgggaccagcgcgggagcggccaggtgggcacgtacgggctcaacaccttcaccaacatggaggtccagctgatccggcagatggagtccgagggcatcttcctgcccagcgagctcgagaccccgaacctggccgagcgcgccctggactggctcgagaagcacggggccgagcggctgaagcgcatggcgatctccggcgacgactgcgtggtgaagcccatcgacgaccggttcgccacggccctgaccgccctcaacgacatggggaaggtccgcaaggacatcccccagtgggagcccagcaagggctggaacgactggcagcaggtcccgttctgctcccaccacttccaccagctgatcatgaaggacggccgggagatcgtggtcccctgccgcaaccaggacgagctggtggggcgggcccgcgtgagccagggcgcggggtggtccctccgggagaccgcctgcctgggcaagagctacgcccagatgtggcagctgatgtacttccaccgccgggacctccgcctggccgcgaacgccatctgcagcgccgtccccgtggactgggtgcccacctcccgcaccacgtggagcatccacgcccaccaccagtggatgaccaccgaggacatgctgtccgtctggaaccgggtgtggatcgaggagaacccgtggatggagaacaagacccacgtgagctcctgggaggaggtcccctacctcgggaagcgcgaggaccagtggtgcggcagcctgatcggcctgacggcccgggcgacctgggccaccaacatccaggtggccatcaaccaggtgcgccggctcatcgggaacgagaactacctggactacatgacctccatgaagcgcttcaagaacgagagcgactccgagggcgccctgtggtga

SEQ ID NO: 8192 - RNA, 9879 nt, synthetic construct
  misc_feature 1..9879: note = derived and/or modified CDS sequence (opt1) from DENV-1__KJ189365__SS-prME
  source 1..9879: mol_type = other RNA
agcgtgaccatgctgctcatgctgctgcccaccgccctcgccttccacctgaccacccgcggcggggagccccacatgatcgtcagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctcgtccaccagatcttcggcaccgcctacggggtgctgttcagcggcgtgtcctggaccatgaagatcgggatcggcatcctgctcacgtggctgggcctgaacagccggtccaccagcctctccatgacctgcatcgtcgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgccgcgatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcccaggggaagaagatgatccgcccccagcccatggagcacaagtactcctggaagtcctggggcaaggcgaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgccgcgatcaaggactccaaggccgtgcacgccgacatgggctactggatcgagagcgagaagaacgagacctggaagctggcccgcgcctccttcatcgaggtcaagacctgcacgtggcccaagagccacaccctgtggtccaacggggtgctcgagagcgagatgatcatccccaagatctacggcgggccgatctcccagcacaactaccggcccggctacttcacccagaccgcggggccctggcacctgggcaagctggagctcgacttcgacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgtgagcatcatgatcgaggaggtgatgcggtcccgctggagccgcaagatgctgatgaccgggacgctcgccgtcttcctgctgctcatcatgggccagctgacctggaacgacctgatccggctctgcatcatggtgggggccaacgcctccgaccgcatgggcatgggcaccacctacctggcgctgatggccacgttcaagatgcggccgatgttcgccgtggggctcctgttccgccggctgaccagccgcgaggtcctcctgctgaccatcggcctctccctggtggccagcgtcgagctgcccaactccctcgaggagctgggggacggcctggccatgggcatcatgatgctcaagctgctgaccgagttccagccccaccagctctggacgaccctgctgagcctcaccttcgtgaagaccacgctgtccctggactacgcgtggaagaccaccgccatggccctcagcatcgtgtccctgttccccctgtgcctcagcaccacgtcccagaagaccacctggctgccggtcctgctcgggagcttcggctgcaagcccctgaccatgttcctgatcaccgagaacaagatctgggggcggaagtcctggcccctcaacgagggcatcatggccatcgggatcgtgagcatcctgctgtccagcctcctgaagaacgacgtgcccctggcgggcccgctcatcgccggcgggatgctgatcgcctgctacgtcatcagcggctccagcgccgacctgtccctcgagaaggccgcggaggtgagctgggagcaggaggccgagcactccggggccagccactccatcctggtggaggtccaggacgacggcacgatgaagatcaaggacgaggagcgcgacgacaccctgaccatcctcctgaaggccaccctgctcgccgtgagcggggtgtaccccatgtccatccccgcgacgctgttcgtctggtacttctggcagaagaagaagcagcggagcggcgtgctgtgggacaccccctccccgcccgaggtggagcgcgccgtcctcgacaacggcatctaccggatcctgcagcgcgggctgctgggccggagccaggtgggggtgggcgtcttccaggacggggtgttccacaccatgtggcacgtgacccgcggcgccgtcctcatgtaccagggcaagcggctggagccctcctgggccagcgtgaagaaggacctgatctcctacgggggcgggtggcgcttccagggcagctggaacacgggggaggaggtgcaggtcatcgccgtggagcccggcaagaacccgaagaacgtgcagaccacccccggcaccttcaagacgcccgagggggaggtcggcgcgatcgccctcgacttcaagcccgggacctccggcagcccgatcgtgaaccgggagggcaagatcgtggggctgtacggcaacggggtcgtgaccacctccggcacgtacgtgagcgccatcgcccaggccaaggcgagccaggaggggcccctgcccgagatcgaggacgaggtcttcaagaagcgcaacctcaccatcatggacctgcacccgggctccggcaagacccggcgctacctgcccgccatcgtgcgggaggccatcaagcgcaagctccgcaccctgatcctggcccccacgcgggtggtcgcgagcgagatggccgaggccctcaaggggatgcccatccgctaccagaccaccgccgtgaagtccgagcacaccggccgggagatcgtggacctgatgtgccacgccacgttcaccatgcgcctgctcagcccggtccgggtgcccaactacaacatgatcatcatggacgaggcgcacttcaccgaccccgcctccatcgccgcccgcgggtacatcagcacccgggtgggcatgggggaggccgcggccatcttcatgacggccacgccgcccggctccgtcgaggccttcccccagagcaacgccgtgatccaggacgaggagcgcgacatccccgagcggtcctggaacagcggctacgactggatcaccgacttccccgggaagaccgtgtggttcgtcccctccatcaagagcggcaacgacatcgcgaactgcctgcgcaagaacgggaagcgggtgatccagctgtcccgcaagacgttcgacaccgagtaccagaagaccaagaacaacgactgggactacgtggtcaccacggacatcagcgagatgggcgccaacttccgggccgaccgcgtgatcgacccccggcgctgcctcaagcccgtgatcctgaaggacgggcccgagcgggtcatcctggccggcccgatgcccgtgaccgcggcctccgccgcccagcgccggggccgcatcgggcgcaaccagaacaaggagggcgaccagtacgtctacatggggcagcccctcaacaacgacgaggaccacgcccactggaccgaggcgaagatgctgctggacaacatcaacacccccgagggcatcatcccggccctcttcgagcccgagcgggagaagtccgccgccatcgacggggagtaccgcctgcggggcgaggcccgcaagacgttcgtggagctgatgcggcgcggcgacctccccgtgtggctgtcctacaaggtcgcgagcgaggggttccagtactccgaccggcgctggtgcttcgacggcgagcggaacaaccaggtgctggaggagaacatggacgtggagatctggaccaaggagggggagcgcaagaagctccggccccgctggctggacgcccggacctacagcgacccgctggccctccgcgagttcaaggagttcgccgccggccggcgcagcgtctccggcgacctgatcctggagatcgggaagctcccccagcacctgaccctgcgggcgcagaacgccctcgacaacctggtgatgctgcacaacagcgagcagggcgggaaggcctaccgccacgccatggaggagctccccgacaccatcgagacgctgatgctgctcgcgctgatcgccgtgctgaccggcggggtcaccctcttcttcctgtccggcaagggcctggggaagaccagcatcggcctcctgtgcgtgacggcctccagcgccctgctctggatggcctccgtggagccccactggatcgcggccagcatcatcctggagttcttcctgatggtcctcctgatcccggagcccgaccggcagcgcacgccccaggacaaccagctggcctacgtggtgatcgggctcctgttcatgatcctgaccgtcgccgccaacgagatgggcctcctggagaccacgaagaaggacctggggatcggctacgtggcggccgagaaccaccagcacgccaccatgctcgacgtggacctgcacccggcctccgcctggaccctgtacgcggtcgccaccacggtgatcacccccatgatgcggcacaccatcgagaacaccacggccaacatcagcctcaccgccatcgccaaccaggcggccatcctgatgggcctggacaaggggtggcccatctccaagatggacatcggcgtgcccctcctggccctggggtgctacagccaggtcaacccgctcaccctgaccgccgcggtgctgatgctcgtggcccactacgccatcatcggccccgggctgcaggccaaggccacgcgcgaggcgcagaagcgcaccgccgccggcatcatgaagaaccccaccgtcgacggcatcgtggccatcgacctggaccccgtggtctacgacgccaagttcgagaagcagctcgggcagatcatgctgctgatcctctgcacctcccagatcctgctgatgcggacgacctgggcgctctgcgagagcatcaccctggccaccggcccgctgacgaccctctgggaggggtcccccggcaagttctggaacaccaccatcgccgtgagcatggccaacatcttccgcggctcctacctggccggggcgggcctggccttcagcctcatgaagtccctcgggggcgggcggcgcggcacgggcgcccagggggagaccctgggcgagaagtggaagcggcagctcaaccagctgagcaagagcgagttcaacacctacaagcgctccgggatcatggaggtggaccggagcgaggccaaggagggcctgaagcgcggggagaccacgaagcacgcggtctcccggggcaccgccaagctccgctggttcgtggagcggaacctggtgaagcccgagggcaaggtcatcgacctggggtgcggccgcgggggctggagctactactgcgccgggctgaagaaggtgaccgaggtgaagggctacaccaagggcgggcccggccacgaggagccgatccccatggccacctacgggtggaacctcgtcaagctgcactccggcaaggacgtgttcttcatgccgcccgagaagtgcgacacgctgctctgcgacatcggggagagctccccgaaccccaccatcgaggagggccggaccctgcgcgtgctgaagatggtcgagccctggctccggggcaaccagttctgcatcaagatcctgaacccctacatgccgagcgtggtggagaccctggagcgcatgcagcggaagcacgggggcatgctcgtccgcaaccccctgtcccggaacagcacgcacgagatgtactgggtgtcctgcgggaccggcaacatcgtgagcgccgtcaacatgacctcccgcatgctgctcaaccgcttcaccatggcgcaccggaagcccacgtacgagcgcgacgtggacctgggcgccgggacccggcacgtggccgtcgagcccgaggtggccaacctggacatcatcggccagcgcatcgagaacatcaagaacgagcacaagagcacctggcactacgacgaggacaacccgtacaagacctgggcctaccacgggtcctacgaggtgaagcccagcggctccgcgagctccatggtcaacggggtggtccggctcctgacgaagccctgggacgtgatccccatggtgacccagatcgccatgaccgacaccacgccgttcggccagcagcgcgtcttcaaggagaaggtggacacccggacgccccgcgccaagcggggcaccacgcagatcatggaggtgaccgccaagtggctgtgggggttcctcagccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctggtgcaccgcgagcgggagctgcacaagcaggggaagtgcgcgacgtgcgtgtacaacatgatgggcaagcgcgagaagaagctcggggagttcggcaaggccaagggcagccgggccatctggtacatgtggctgggggcccgcttcctggagttcgaggccctcggcttcatgaacgaggaccactggttctcccgggagaacagcctgtccggggtcgagggcgaggggctgcacaagctcggctacatcctgcgcgacatcagcaagatcccgggcgggaacatgtacgcggacgacaccgccggctgggacacccgcgtgaccgaggacgacctgcagaacgaggccaagatcacggacatcatggagcccgagcacgccctcctggccacctccatcttcaagctgacctaccagaacaaggtggtccgggtgcagcgccccgcgaagaacgggaccgtgatggacgtcatcagccggcgcgaccagcggggctccggccaggtggggacgtacggcctcaacaccttcaccaacatggaggtgcagctgatccgccagatggagagcgaggggatcttcctgccctccgagctcgagaccccgaacctggccgagcgggccctggactggctcgagaagcacggcgccgagcgcctgaagcggatggccatcagcggggacgactgcgtcgtgaagcccatcgacgaccgcttcgcgacggccctgaccgccctcaacgacatgggcaaggtgcggaaggacatcccccagtgggagccctccaagggctggaacgactggcagcaggtcccgttctgcagccaccacttccaccagctgatcatgaaggacgggcgcgagatcgtggtgccctgccggaaccaggacgagctggtcggccgcgcccgggtgtcccagggggccggctggagcctccgcgagaccgcgtgcctggggaagtcctacgcccagatgtggcagctgatgtacttccaccggcgcgacctccggctggccgccaacgcgatctgcagcgccgtgcccgtcgactgggtgcccaccagccgcaccacgtggtccatccacgcccaccaccagtggatgaccaccgaggacatgctgagcgtgtggaaccgcgtctggatcgacgagaacccgtggatggagaacaagacccacgtgtccagctgggaggaggtgccctacctcggcaagcgggaggaccagtggtgcggctccctgatcgggctgacggcccgcgccacctgggcgaccaacatccaggtcgccatcaaccaggtgcggcgcctcatcggcaacgagaactacctggactacatgaccagcatgaagcggttcaagaacgagtccgacagcgagggggccctgtggtga

SEQ ID NO: 8193 - RNA, 9879 nt, synthetic construct
  misc_feature 1..9879: note = derived and/or modified CDS sequence (opt1) from DENV-1__KJ189366__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgccggggtgaacatgtgcaccctgatcgccatggacctgggcgagctctgcgaggacacgatgacctacaagtgcccccgcatcgccgaggccgagcccgacgacgtggactgctggtgcaacgccaccgacacctgggtgacgtacgggacctgcagccagaccggcgagcaccggcgcgagaagcggtccgtggcgctggcgccccacgtgggcctggggctcgagacccgcacggagacctggatgagctccgagggcgcctggaagcagatccagcgggtcgagacctgggccctgcgccaccccgggttcaccgtgatcgccttcttcctggcccacgccatcggcacgagcatcacccagaaggggatcatcttcatcctcctgatgctggtgaccccctccatggccatgcggtgcgtcggcatcggcaaccgcgacttcgtggaggggctcagcggcgccacctgggtggacgtcgtgctggagcacgggtcctgcgtgacgaccatggcgaagaacaagcccaccctggacatcgagctcctgaagaccgaggtcacgaaccccgccgtgctgcggaagctctgcatcgaggccaagatcagcaacaccaccaccgactcccgctgccccacgcagggcgaggccaccctggtggaggagcaggacgccaacttcgtctgccggcgcaccttcgtggaccggggctgggggaacggctgcgggctgttcggcaaggggagcctcctgacctgcgcgaagttcaagtgcgtgacgaagctggagggcaagatcgtccagtacgagaacctcaagtactccgtgatcgtgaccgtccacaccggcgaccagcaccaggtggggaacgagaccacggagcacggcaccatcgccaccatcacgccccaggcccccaccagcgagatccagctgacggactacggggccctgaccctcgactgcagcccccggaccggcctggacttcaacgagatggtcctgctcaccatgaaggagaagtcctggctggtgcacaagcagtggttcctggacctcccgctgccctggacgtccggggccagcaccagccaggagacctggaaccggcaggacctgctcgtgaccttcaagacggcgcacgccaagaagcaggaggtcgtggtgctgggctcccaggagggcgccatgcacaccgccctgaccggggccaccgagatccagacgagcggcaccaccaccatcttcgcggggcacctcaagtgccgcctgaagatggacaagctgacgctcaagggcatgtcctacgtcatgtgcaccgggagcttcaagctggagaaggaggtggccgagacccagcacggcaccgtgctggtccaggtgaagtacgagggcacggacgccccctgcaagatccccttctccacccaggacgagaagggggtgacccagaacggccggctgatcaccgccaacccgatcgtcacggacaaggagaagcccgtgaacatcgagaccgagccgcccttcggggagagctacatcgtggtcggcgcgggcgagaaggccctcaagctgtcctggttcaagcgcgggagctccatcggcaagatgttcgaggccaccgcccgcggggcccgccgcatggcgatcctgggcgacaccgcctgggacttcgggagcatcggcggcgtgttcacgtccgtggggaagctcgtccaccagatcttcggcaccgcctacggggtgctgttcagcggcgtgtcctggaccatgaagatcgggatcggcatcctgctcacctggctgggcctgaacagccggtccacgagcctctccatgacctgcatcgccgtcgggatggtgaccctgtacctgggcgtgatggtccaggccgacagcgggtgcgtgatcaactggaagggccgcgagctcaagtgcgggtccggcatcttcgtgaccaacgaggtccacacgtggaccgagcagtacaagttccaggcggacagcccgaagcggctgagcgccgccatcggcaaggcctgggaggagggggtgtgcggcatccgctccgccacccggctggagaacatcatgtggaagcagatcagcaacgagctcaaccacatcctgctggagaacgacatgaagttcaccgtggtcgtgggggacgcgaacggcatcctcgcccaggggaagaagatgatccgcccccagcccatggagcacaagtactcctggaagtcctggggcaaggccaagatcatcggcgccgacatccagaacaccacgttcatcatcgacgggcccgacaccccggagtgccccgacggccagcgggcgtggaacatctgggaggtggaggactacgggttcggcgtcttcaccaccaacatctggctgaagctgcgcgactcctacacgcagatgtgcgaccaccggctcatgagcgccgccatcaaggactccaaggccgtgcacgccgacatgggctactggatcgagagcgagaagaacgagacctggaagctggcgcgcgcctccttcatcgaggtgaagacctgcacctggcccaagagccacacgctgtggtccaacggggtcctcgagagcgagatgatcatccccaagatctacggcgggccgatctcccagcacaactaccggcccggctacttcacccagaccgccgggccctggcacctgggcaagctggagctcgacttcgacctgtgcgagggcaccacggtggtggtcgacgagcactgcgggaaccgcggcccgagcctgcggaccaccaccgtgacggggaagatcatccacgagtggtgctgccgctcctgcaccctgccgcccctgcggttccgcggcgaggacgggtgctggtacggcatggagatccggcccgtgaaggagaaggaggagaacctggtccgcagcatggtgtccgccggcagcggggaggtggacagcttctccctcggcatcctgtgcgtcagcatcatgatcgaggaggtgatgcggtcccgctggagccgcaagatgctgatgaccgggaccctcgccgtgttcctgctgctcatcatgggccagctgacgtggaacgacctgatccggctctgcatcatggtcggggcgaacgcctccgaccgcatgggcatgggcaccacctacctggccctgatggccaccttcaagatgcggccgatgttcgccgtggggctcctgttccgccggctgacgagccgcgaggtgctcctgctgaccatcggcctctccctggtcgcgagcgtggagctgcccaactccctcgaggagctgggggacggcctggccatgggcatcatgatgctcaagctgctgaccgagttccagccccaccagctctggaccacgctgctgagcctcaccttcgtcaagaccaccctgtccctggactacgcctggaagacgaccgccatggcgctcagcatcgtgtccctgttccccctgtgcctcagcaccacctcccagaagacgacctggctgccggtgctgctcgggagcttcggctgcaagcccctgaccatgttcctgatcaccgagaacaagatctgggggcggaagtcctggcccctcaacgagggcatcatggccatcgggatcgtcagcatcctgctgtccagcctcctgaagaacgacgtgcccctggccggcccgctcatcgccggcgggatgctgatcgcctgctacgtgatcagcggctccagcgcggacctgtccctcgagaaggccgccgaggtcagctgggagcaggaggccgagcactccggggccagccactccatcctggtggaggtgcaggacgacggcaccatgaagatcaaggacgaggagcgcgacgacacgctgaccatcctcctgaaggcgaccctgctcgccgtcagcggggtgtaccccatgtccatccccgccaccctgttcgtgtggtacttctggcagaagaagaagcagcggagcggcgtcctgtgggacacgccctccccgcccgaggtggagcgcgccgtgctcgacaacggcatctaccggatcctgcagcgcgggctgctgggccggagccaggtcggggtgggcgtgttccaggacggggtcttccacaccatgtggcacgtgacccgcggcgccgtgctcatgtaccagggcaagcggctggagccctcctgggcgagcgtcaagaaggacctgatctcctacgggggcgggtggcgcttccagggcagctggaacaccggggaggaggtccaggtgatcgccgtcgagcccggcaagaacccgaagaacgtgcagacgacccccggcaccttcaagacccccgagggggaggtgggcgccatcgccctcgacttcaagcccgggacgtccggcagcccgatcgtcaaccgggagggcaagatcgtggggctgtacggcaacggggtggtcaccacctccggcacctacgtgagcgccatcgcgcaggccaaggccagccaggaggggcccctgcccgagatcgaggacgaggtgttcaagaagcgcaacctcacgatcatggacctgcacccgggctccggcaagacccggcgctacctgcccgccatcgtccgggaggcgatcaagcgcaagctccgcaccctgatcctggcccccacccgggtggtggccagcgagatggccgaggccctcaaggggatgcccatccgctaccagacgaccgcggtcaagtccgagcacaccggccgggagatcgtggacctgatgtgccacgccaccttcacgatgcgcctgctcagcccggtgcgggtccccaactacaacatgatcatcatggacgaggcccacttcaccgaccccgcctccatcgccgcgcgcgggtacatcagcacccgggtgggcatgggggaggccgccgccatcttcatgaccgccacgcccccgggctccgtggaggcgttcccccagagcaacgccgtcatccaggacgaggagcgcgacatccccgagcggtcctggaacagcggctacgactggatcaccgacttccccgggaagaccgtgtggttcgtgccgtccatcaagagcggcaacgacatcgccaactgcctgcgcaagaacgggaagcgggtcatccagctgtcccgcaagaccttcgacacggagtaccagaagaccaagaacagcgactgggactacgtggtgaccaccgacatctccgagatgggcgccaacttccgggcggaccgcgtcatcgacccccggcgctgcctcaagcccgtgatcctgaaggacgggcccgagcgggtgatcctggccggcccgatgcccgtcacggccgccagcgccgcgcagcgccggggccgcatcgggcgcaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgggagaagtccgccgcgatcgacggggagtaccgcctgcggggcgaggcccgcaagaccttcgtcgagctgatgcggcgcggcgacctccccgtgtggctgagctacaaggtggcctccgaggggttccagtacagcgaccggcgctggtgcttcgacggcgagcggaacaaccaggtcctggaggagaacatggacgtggagatctggacgaaggagggggagcgcaagaagctccggccccgctggctggacgcccggacctacagcgacccgctggccctccgcgagttcaaggagttcgcggccggccggcgctccgtgagcggcgacctgatcctggagatcgggaagctcccccagcacctgaccctgcgggcccagaacgccctcgacaacctggtcatgctgcacaactccgagcagggcgggaaggcgtaccgccacgccatggaggagctccccgacaccatcgagaccctgatgctgctcgccctgatcgccgtgctgacgggcggggtgaccctcttcttcctgagcggcaagggcctggggaagacctccatcggcctcctgtgcgtcaccgccagctccgcgctgctctggatggccagcgtggagccccactggatcgccgcctccatcatcctggagttcttcctgatggtgctcctgatcccggagcccgaccggcagcgcacgccccaggacaaccagctggcctacgtcgtgatcgggctcctgttcatgatcctgaccgtggcggccaacgagatgggcctcctggagaccaccaagaaggacctggggatcggctacgtcgccgccgagaaccaccagcacgtgacgatgctcgacgtggacctgcacccggccagcgcgtggaccctgtacgccgtcgccaccaccgtgatcacgcccatgatgcggcacaccatcgagaacgccaccgccaacatctccctcaccgcgatcgccaaccaggccgccatcctgatgggcctggacaaggggtggcccatcagcaagatggacatcggcgtgcccctcctggcgctggggtgctactcccaggtcaacccgctcacgctgaccgccgccgtgctgatgctcgtggcccactacgccatcatcggccccgggctgcaggcgaaggccacccgcgaggcccagaagcgcaccgccgccggcatcatgaagaaccccacggtcgacggcatcgtggcgatcgacctggaccccgtggtctacgacgccaagttcgagaagcagctcgggcagatcatgctgctgatcctctgcaccagccagatcctgctgatgcggaccacctgggccctctgcgagtccatcacgctggccaccggcccgctgaccaccctctgggaggggagccccggcaagttctggaacacgaccatcgccgtgtccatggcgaacatcttccgcggcagctacctggccggggccggcctggccttctccctcatgaagtccctcgggggcgggcggcgcgggaccggcgcgcagggggagaccctgggcgagaagtggaagcggcagctcaaccagctgagcaagtccgagttcaacacgtacaagcgcagcgggatcatggaggtggaccggtccgaggccaaggagggcctgaagcgcggggagaccaccaagcacgccgtcagccggggcaccgccaagctccgctggttcgtggagcggaacctggtgaagcccgagggcaaggtcatcgacctggggtgcggccgcgggggctggtcctactactgcgccgggctgaagaaggtgacggaggtgaagggctacaccaagggcgggcccggccacgaggagccgatccccatggcgacctacgggtggaacctcgtcaagctgcacagcggcaaggacgtgttcttcatgccgcccgagaagtgcgacaccctgctctgcgacatcggggagtccagcccgaaccccaccgtggaggagggccggacgctgcgcgtcctgaagatggtggagccctggctccggggcaaccagttctgcatcaagatcctgaacccctacatgccgtccgtggtcgagaccctggagcgcatgcagcggaagcacgggggcatgctcgtgcgcaaccccctgagccggaactccacccacgagatgtactgggtgagctgcgggaccggcaacatcgtctccgccgtgaacatgacgagccgcatgctgctcaaccgcttcaccatggcccaccggaagcccacctacgagcgcgacgtggacctgggcgccgggacccggcacgtcgccgtggagcccgaggtggcgaacctggacatcatcggccagcgcatcgagaacatcaagaacgagcacaagtccacgtggcactacgacgaggacaacccgtacaagacctgggcctaccacgggagctacgaggtcaagccctccggcagcgcctccagcatggtgaacggggtcgtgcggctcctgaccaagccctgggacgtgatccccatggtcacccagatcgccatgacggacaccaccccgttcggccagcagcgcgtgttcaaggagaaggtggacacccggacgccccgcgccaagcggggcaccacccagatcatggaggtcaccgcgaagtggctgtgggggttcctcagccgcaacaagaagccccggatctgcacgcgcgaggagttcacccggaaggtgcgctccaacgccgccgtgggcgccgtcttcgtggacgagaaccagtggaacagcgcgaaggaggccgtggaggacgagcggttctgggacctggtccaccgcgagcgggagctgcacaagcaggggaagtgcgcgacctgcgtgtacaacatgatgggcaagcgcgagaagaagctcggggagttcggcaaggccaagggctcccgggccatctggtacatgtggctgggggcgcgcttcctggagttcgaggccctcggcttcatgaacgaggaccactggttcagccgggagaactccctgagcggggtggagggcgaggggctgcacaagctcggctacatcctgcgcgacatctccaagatcccgggcgggaacatgtacgccgacgacaccgccggctgggacacgcgcgtcaccgaggacgacctgcagaacgaggccaagatcaccgacatcatggagcccgagcacgcgctcctggccaccagcatcttcaagctgacgtaccagaacaaggtggtgcgggtccagcgccccgccaagaacgggaccgtgatggacgtgatctcccggcgcgaccagcggggcagcggccaggtcgggacctacggcctcaacaccttcacgaacatggaggtgcagctgatccgccagatggagtccgaggggatcttcctgcccagcgagctcgagaccccgaacctggccgagcgggccctggactggctcgagaagcacggcgcggagcgcctgaagcggatggccatctccggggacgactgcgtggtcaagcccatcgacgaccgcttcgccaccgccctgaccgccctcaacgacatgggcaaggtgcggaaggacatcccccagtgggagcccagcaagggctggaacgactggcagcaggtcccgttctgctcccaccacttccaccagctgatcatgaaggacgggcgcgagatcgtcgtgccctgccggaaccaggacgagctggtgggccgcgcgcgggtcagccagggggccggctggtccctccgcgagacggcctgcctgggcaagagctacgcccagatgtggcagctgatgtacttccaccggcgcgacctccggctggcggccaacgccatctgcagcgccgtgcccgtggactgggtccccacctcccgcaccacctggagcatccacgcccaccaccagtggatgaccacggaggacatgctgtccgtgtggaaccgcgtgtggatcgaggagaacccgtggatggagaacaagacccacgtcagctcctgggaggaggtgccctacctcggcaagcgggaggaccagtggtgcggcagcctgatcgggctgaccgcgcgcgccacctgggccacgaacatccaggtggccatcaaccaggtccggcgcctcatcggcaacgagaactacctggactacatgacctccatgaagcggttcaagaacgagagcgactccgagggggccctgtggtga

SEQ ID NO: 8194 - RNA, 9879 nt, synthetic construct
  misc_feature 1..9879: note = derived and/or modified CDS sequence (opt1) from DENV-1__JN819417__SS-prME
  source 1..9879: mol_type = other RNA
agcgtgaccatgctgctcatgctgctgcccaccgccctcgccttccacctgaccacccggggcggggagccccacatggtcgtgagcaagcaggagcggggcaagagcctgctgttcaagaccagcgccggggtgaacatgtgcaccctgatcgccatggacctgggcgagctctgcgaggacaccatgacctacaagtgcccccggatcaccgaggccgagcccgacgacgtcgactgctggtgcaacgccaccgacacctgggtgacctacgggacctgcagccagaccggcgagcaccggcgggacaagcggtccgtggccctggcgccccacgtcggcctggggctcgagacccggaccgagacctggatgagctccgagggcgcctggaagcagatccagaaggtggagacctgggccctgcggcaccccgggttcacggtgatcgccctgttcctcgcgcacgccatcggcaccagcatcacccagaaggggatcatcttcatcctgctgatgctcgtcaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgcgatcctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagcacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccacgagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgcgagctgaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcaccgtcgtggtgggggacgcctccggcatcctggcgcaggggaagaagatgatccgcccccagcccatggagcacaagtacagctggaagtcctggggcaaggccaagatcatcggcgccgacacgcagaacaccaccttcatcatcgacgggcccgacaccccggagtgccccgacgaccagcgggcctggaacatctgggaggtcgaggactacggcttcgggatcttcacgaccaacatctggctgaagctccgcgacagctacacccagatgtgcgaccaccggctgatgtccgcggccatcaaggacagcaaggccgtgcacgccgacatgggctactggatcgagtccgagaagaacgagacctggaagctggcccgcgcgagcttcatcgaggtgaagacgtgcatctggcccaagtcccacaccctctggagcaacggcgtcctggagtccgagatgatcatccccaagatctacgggggcccgatcagccagcacaactaccggcccgggtacttcacccagaccgccggcccctggcacctggggaagctcgagctggacttcgacctgtgcgagggcacgaccgtggtggtcgacgagcactgcggcaaccgcgggccgtccctccggaccaccacggtgaccggcaagatcatccacgagtggtgctgccgcagctgcaccctgccgcccctgcggttccgcggggaggacggctgctggtacgggatggagatccggcccgtgaaggagaaggaggagaacctcgtccgctccatggtgagcgccggcagcggcgaggtggactccttcagcctggggatcctgtgcgtctccatcatgatcgaggaggtgatgcggagccgctggtcccggaagatgctcatgaccggcacgctggccgtgttcctgctcctgatcatggggcagctgacctggaacgacctcatccgcctgtgcatcatggtcggcgccaacgcgagcgaccgcatggggatgggcaccacctacctggccctcatgggcacgttcaagatgcggccgatgttcgccgtggggctgctgttccgccggctcacctcccgcgaggtgctgctgctcaccatcggcctgagcctggtcgcctccgtggagctccccaacagcctggaggagctgggggacggcctcgccatgggcatcatgatgctgaagctgctcaccgagttccagccccaccagctgtggacgaccctgctctccctgaccttcatcaagaccacgctgagcctcgactacgcgtggaagaccatggccatggtcctgtccatcgtgagcctgttccccctctgcctgtccaccaccagccagaagacgacctggctgccggtgctcctggggtccttcggctgcaagcccctgaccatgttcctcatcaccgagaacaagatctgggggcgcaagagctggcccctgaacgagggcatcatggccatcgggatcgtctccatcctgctcagcagcctgctgaagaacgacgtgcccctcgccggcccgctgatcgcgggcgggatgctgatcgcctgctacgtgatctccggcagctccgccgacctcagcctggagaaggccgccgagatctcctgggaggaggaggcggagcacagcgggacctcccacaacatcctggtcgaggtgcaggacgacggcacgatgaagatcaaggacgaggagcgcgacgacaccctcaccatcctgctgaaggccaccctcctggccgtgagcggggtctaccccatgtccatccccgccacgctgttcgtgtggtacttctggcagaagaagaagcagcggagcggcgtgctctgggacaccccctccccgcccgaggtcgagcgcgccgtgctggacgacggcatctaccggatcctgcagcgcgggctgctcggccggagccaggtgggggtcggcgtgttccaggacggggtgttccacaccatgtggcacgtcacccgcggcgcggtgctgatgtaccagggcaagcggctggagccctcctgggccagcgtgaagaaggacctcatctcctacgggggcgggtggcgcttccagggcagctggaacacgggggaggaggtccaggtgatcgccgtggagcccggcaagaacccgaagaacgtccagaccacccccggcaccttcaagacgcccgagggggaggtgggcgccatcgccctggacttcaagcccgggacctccggcagcccgatcgtgaaccgggagggcaagatcgtcgggctgtacggcaacggggtggtgaccacctccggcacgtacgtcagcgcgatcgcccaggccaaggccagccaggaggggcccctccccgagatcgaggacgaggtgttcaagaagcgcaacctgaccatcatggacctgcacccgggctccggcaagacccggcgctacctccccgccatcgtgcgggaggcgatcaagcgcaagctgcggaccctgatcctcgcccccacgcgcgtcgtggccagcgagatggccgaggcgctgaaggggatgcccatccgctaccagaccaccgccgtgaagtccgagcacaccggccgggagatcgtcgacctgatgtgccacgccacgttcaccatgcgcctcctgagcccggtgcgggtgcccaactacaacatgatcatcatggacgaggcccacttcaccgaccccgcctccatcgcggcccgcgggtacatcagcacccgggtcggcatgggggaggccgccgccatcttcatgacggcgacgccgcccggctccgtggaggccttcccccagagcaacgccgtgatccaggacgaggagcgcgacatccccgagcggtcctggaacagcggctacgactggatcaccgacttccccgggaagaccatctggttcgtcccctccatcaagagcggcaacgacatcgccaactgcctgcgcaagaacgggaagcgggtgatccagctctcccgcaagacgttcgacaccgagtaccagaagaccaagaacaacgactgggactacgtggtcaccacggacatcagcgagatgggcgccaacttccgggcggaccgcgtgatcgacccccggcgctgcctgaagcccgtgatcctgaaggacgggcccgagcgggtcatcctcgccggcccgatgcccgtgaccgtggcctccgccgcgcagcgccggggccgcatcgggcggaaccagaacaaggagggcgaccagtacgtctacatggggcagcccctgaacaacgacgaggaccacgcccactggaccgaggccaagatgctgctcgacaacatcaacacccccgagggcatcatcccggccctgttcgagcccgagcgcgagaagtccgccgcgatcgacggggagtaccgcctgcggggcgaggcccgcaagacgttcgtggagctcatgcggcgcggcgacctgcccgtctggctgtcctacaaggtggccagcgaggggttccagtactccgaccggcgctggtgcttcgacggcgagcggaacaaccaggtgctcgaggagaacatggacgtcgagatctggaccaaggagggggagcgcaagaagctgcggccccgctggctggacgcccggacctacagcgacccgctcgccctgcgcgagttcaaggagttcgcggccggccggcgcagcatctccggcgacctgatcctcgagatcgggaagctgccccagcacctgaccctccgggcccagaacgccctggacaacctggtgatgctccacaacagcgagcagggcgggaaggcctaccgccacgcgatggaggagctgcccgacaccatcgagacgctgatgctcctggccctgatcgccgtgctcaccggcggggtcaccctgttcttcctgtccggcaagggcctcgggaagaccagcatcggcctgctgtgcgtgatggcctccagcgcgctcctgtggatggccaacgtggagccccactggatcgccgcctccatcatcctggagttcttcctcatggtcctgctgatcccggagcccgaccggcagcgcacgccccaggacaaccagctcgcctacgtggtgatcgggctgctgttcatgatcctcaccgtcgcggccaacgagatgggcctgctggagaccaccaagaaggacctcgggatcggccacgtggccgccgagaaccaccaccacgccacgatgctggacgtggacctgcggccggcgagcgcctggaccctctacgccgtcgccaccaccgtgatcacgcccatgatgcgccacaccatcgagaacaccaccgccaacatctccctgacggcgatcgccaaccaggccgccatcctgatgggcctcgacaaggggtggcccatcagcaagatggacatcggcgtgcccctgctggccctcgggtgctactcccaggtcaacccgctgaccctgaccgcggccgtgctcatgctggtggcccactacgccatcatcggccccgggctgcaggcgaaggccacccgggaggcccagaagcgcacggccgccggcatcatgaagaaccccaccgtcgacggcatcgtggcgatcgacctcgaccccgtggtctacgacgccaagttcgagaagcagctggggcagatcatgctgctcatcctgtgcaccagccagatcctgctcatgcgcaccacgtgggccctgtgcgagtccatcaccctggccaccggcccgctcaccacgctgtgggaggggagccccggcaagttctggaacaccaccatcgccgtgtccatggcgaacatcttccggggcagctacctggccggggccggcctcgccttctccctgatgaagtccctcgggggcgggcgccgggggaccggcgcccagggggagacgctcggcgagaagtggaagcgccagctgaaccagctgtccaagagcgagttcaacacctacaagcggagcgggatcatggaggtggaccgctccgaggcgaaggagggcctcaagcgcggggagaccaccaagcacgccgtcagccgcggcacggccaagctgcggtggttcgtggagcgcaacctggtgaagcccgagggcaaggtcatcgacctggggtgcggccgcggcgggtggtcctactactgcgccgggctcaagaaggtgaccgaggtgaaggggtacaccaagggcgggcccggccacgaggagccgatccccatggcgacctacgggtggaacctggtcaagctgcacagcggcaaggacgtgttcttcacgccgcccgagaagtgcgacacgctcctgtgcgacatcggggagtccagcccgaaccccaccatcgaggagggccgcaccctgcgggtgctcaagatggtcgagccctggctgcgcggcaaccagttctgcatcaagatcctgaacccctacatgccgtccgtggtggagaccctcgagcagatgcagcggaagcacgggggcatgctggtccgcaaccccctgagccggaactccacgcacgagatgtactgggtgagctgcgggaccggcaacatcgtgtccgccgtcaacatgaccagccgcatgctcctgaaccggttcaccatggcccaccgcaagcccacgtacgagaaggacgtggacctgggcgccgggacccgccacgtggccgtcgagcccgaggtggcgaacctcgacatcatcggccagcggatcgagaacatcaagaacgagcacaagtccacctggcactacgacgaggacaacccgtacaagacctgggcctaccacgggagctacgaggtgaagccctccggcagcgcctccagcatggtcaacggggtggtgcgcctgctgacgaagccctgggacgtcatccccatggtgacccagatcgccatgaccgacaccacgccgttcggccagcagcgggtcttcaaggagaaggtggacacccgcacgccccgggccaagcgcggcaccgcgcagatcatggaggtgacggccaagtggctctgggggttcctgtcccggaacaagaagccccgcatctgcacccgggaggagttcaccaagaaggtccgcagcaacgccgccatcggcgccgtgttcgtggacgagaaccagtggaacagcgcgaaggaggccgtcgaggacgagcggttctgggacctggtgcaccgcgagcgggagctccacaagcaggggaagtgcgcgacctgcgtgtacaacatgatgggcaagcgcgagaagaagctgggggagttcggcaaggccaagggctcccgggcgatctggtacatgtggctgggggcccgcttcctcgagttcgaggccctgggcttcatgaacgaggaccactggttcagccgggagaactccctgagcggggtcgagggcgaggggctccacaagctgggctacatcctgcgcgacatctccaagatcccgggcgggaacatgtacgccgacgacacggccggctgggacacccggatcaccgaggacgacctccagaacgaggcgaagatcaccgacatcatggagcccgagcacgccctgctggccacgagcatcttcaagctcacctaccagaacaaggtggtgcgcgtccagcggcccgccaagaacgggaacgtgatggacgtgatctcccgccgcgaccagcggggcagcggccaggtcgggacctacggcctgaacaccttcacgaacatggaggtgcagctgatccgccagatggagtccgaggggatcttcctccccagcgagctggagaccccgaacctggccgagcgggtgctcgactggctggagaagcacggcgcggagcgcctgaagcggatggccatctccggggacgactgcgtcgtgaagcccatcgacgaccgcttcgccaccgccctcatcgccctgaacgacatgggcaaggtgcggaaggacatcccccagtgggagcccagcaagggctggaacgactggcagcaggtcccgttctgctcccaccacttccaccagctgatcatgaaggacgggcgcgagatcgtggtgccctgccggaaccaggacgagctcgtcggccgcgcgcgggtgagccagggggccggctggtccctgcgcgagaccgcctgcctgggcaagagctacgcccagatgtggcagctcatgtacttccaccggcgcgacctgcggctggccgcgaacgccatctgctccgccgtgcccgtcgactgggtgcccacgagccgcaccacctggagcatccacgcccaccaccagtggatgaccaccgaggacatgctctccgtgtggaaccgggtctggatcgaggagaacccgtggatggaggacaagacgcacgtgagctcctgggaggaggtgccctacctgggcaagcgcgaggaccagtggtgcggcagcctgatcgggctcaccgcgcgggccacctgggccaccaacatccaggtcgccatcaaccaggtgcgccgcctgatcggcaacgagaactacctggactacatgacgtccatgaagcggttcaagaacgagagcgaccccgagggggccctctggtga

SEQ ID NO: 8195 - RNA, 9879 nt, synthetic construct
  misc_feature 1..9879: note = derived and/or modified CDS sequence (opt1) from DENV-1__FJ687426__SS-prME
  source 1..9879: mol_type = other RNA
agcgtgaccatgctgctcatgctgatgcccaccgccctggccttccacctcaccacccggggcggggagccccacatgatcgtcagcaagcaggagcggggcaagagcctgctgttcaagaccagcgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagtacaagtacagctggaagtcctggggcaaggccaagatcatcggcgccgacgtgcagaacagcacgttcatcatcgacgggcccaacaccccggagtgccccgacgaccagcgcgcgtggaacatctgggaggtcgaggactacggcttcgggatcttcaccaccaacatctggctgaagctccgggactcctacacccaggtgtgcgaccaccgcctgatgagcgccgccatcaaggactccaaggccgtgcacgccgacatgggctactggatcgagagcgagaagaacgagacctggaagctggcgggcgcctccttcatcgaggtcaagacctgcatctggcccaagagccacaccctctggtccaacggggtgctggagagcgagatgatcatccccaagatctacggcgggccgatctcccagcacaactaccggcccggctacttcacgcagaccgccgggccctggcacctgggcaagctcgagctggacttcgacctgtgcgagggcaccaccgtggtcgtggacgagcactgcgggaaccgcggcccgagcctccggacgaccaccgtgaccgggaagatcatccacgagtggtgctgccgctcctgcacgctgccgcccctgcggttccgcggcgaggacgggtgctggtacggcatggagatccggcccgtcaaggagaaggaggagaacctcgtgaagtccatggtgagcgccggctccggggaggtcgacagcttctccctgggcctgctctgcatcagcatcatgatcgaggaggtgatgcgctcccggtggagccgcaagatgctgatgaccgggaccctggccgtgttcttcctcctgatcatgggccagctgacctggaacgacctcatccggctgtgcatcatggtcggggcgaacgcctccgaccgcatgggcatgggcacgacctacctggccctcatggccaccttcaagatgcgcccgatgttcgccgtggggctgctgttccggcgcctcaccagccgggaggtgctgctgctcacgatcggcctgtccctggtcgcgagcgtggagctccccaactccctggaggagctgggggacggcctcgccatgggcatcatgatcctgaagctgctcaccgacttccagagccaccagctgtgggccaccctgctctccctgaccttcatcaagacgaccctgagcctccactacgcctggaagaccatggcgatggtcctgtccatcgtgagcctgttccccctctgcctgtccaccacgagccagaagaccacctggctgcccgtgctcctggggtccctgggctgcaagccgctcaccatgttcctgatcgccgagaacaagatctgggggcgcaagagctggcccctgaacgagggcatcatggccgtcgggatcgtgagcatcctcctgtccagcctgctcaagaacgacgtgcccctggccggccccctgatcgccggcgggatgctcatcgcgtgctacgtcatctccggcagctccgccgacctgagcctggagaaggccgccgaggtgtcctgggaggaggaggccgagcacagcggggcgtcccacaacatcctcgtggaggtccaggacgacggcacgatgaagatcaaggacgaggagcgggacgacaccctgaccatcctgctcaaggccaccctgctggccgtgagcggggtgtacccgctctccatccccgccaccctgttcgtctggtacttctggcagaagaagaagcagcgcagcggcgtgctgtgggacacgcccagcccgcccgaggtggagcgggccgtcctggacgacggcatctaccgcatcatgcagcgggggctcctgggccgcagccaggtgggggtgggcgtcttccaggagaacgtgttccacaccatgtggcacgtgacccgcggggccgtcctgatgtaccagggcaagcgcctcgagccctcctgggccagcgtgaagaaggacctgatctcctacggcgggggctggcggctgcaggggagctggaacaccggcgaggaggtgcaggtcatcgccgtggagcccgggaagaaccccaagaacgtgcagacggcccccggcaccttcaagacccccgagggcgaggtcggggccatcgcgctcgacttcaagcccggcacctccgggagccccatcgtgaaccgcgagggcaagatcgtgggcctgtacgggaacggcgtcgtgacgaccagcgggacctacgtgtccgccatcgcccaggccaaggcgagccaggagggcccgctgcccgagatcgaggacgaggtcttccggaagcgcaacctcaccatcatggacctgcaccccgggtccggcaagacgcggcgctacctgccggccatcgtgcgggaggccatcaagcgcaagctccggaccctgatcctggcccccacccgcgtggtcgccagcgagatggcggaggccctcaagggcatgcccatccgctaccagaccacggccgtgaagtccgagcacaccgggaaggagatcgtggacctgatgtgccacgccaccttcaccatgcggctgctcagccccgtccgcgtgccgaactacaacatgatcatcatggacgaggcccacttcacggacccctccagcatcgcggcccggggctacatctccacccgcgtggggatgggcgaggccgccgccatcttcatgaccgcgacgccgcccgggagcgtcgaggccttcccgcagtccaacgccgtgatccaggacgaggagcgggacatccccgagcgcagctggaactccggctacgagtggatcacggacttccccggcaagaccgtgtggttcgtccccagcatcaaggccgggaacgacatcgcgaactgcctgcggaagaacggcaagcgcgtgatccagctgtcccggaagaccttcgacaccgagtaccagaagacgaagaacaacgactgggactacgtggtcaccaccgacatcagcgagatgggggccaacttccgcgccgaccgggtgatcgacccgcgccggtgcctcaagcccgtgatcctgaaggacggccccgagcgcgtcatcctggccgggcccatgccggtgaccgtcgcctccgcggcccagcggcgcggccggatcggccgcaaccacaacaaggagggggaccagtacatctacatgggccagcccctcaacaacgacgaggaccacgcccactggacggaggccaagatgctgctggacaacatcaacacccccgaggggatcatccccgccctcttcgagccggagcgggagaagtccgcggccatcgacggcgagtaccgcctgcgcggggaggcccggaagaccttcgtggagctgatgcgccggggcgacctccccgtgtggctgtcctacaaggtcgccagcgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacgtactccgaccccctggcgctccgggagttcaaggagttcgccgccgggcgccggagcgtctccggcgacctgatcctggagatcggcaagctcccgcagcacctgacccagcgcgcccagaacgcgctggacaacctcgtgatgctgcacaacagcgagcagggcgggcgggcctaccgccacgccatggaggagctgcccgacaccatcgagaccctcatgctgctggccctcatcgccgtgctgaccgggggcgtcaccctgttcttcctctccgggaagggcctgggcaagaccagcatcgggctgctctgcgtgatggcgtccagcgtgctgctgtggatggcctccgtcgagccccactggatcgccgccagcatcatcctcgagttcttcctgatggtgctgctcatccccgagccggaccggcagcgcacgccccaggacaaccagctggcctacgtggtcatcggcctcctgttcatgatcctgaccgtggcggccaacgagatggggctgctcgagacgaccaagaaggacctgggcatcgggcacgtggccgtcgagaaccaccaccacgccgccatgctggacgtggacctccaccccgcgtccgcctggaccctgtacgccgtggccaccacgatcatcaccccgatgatgcggcacaccatcgagaacaccacggccaacatcagcctgaccgcgatcgccaaccaggccgccatcctcatgggcctggacaagggctggcccatctccaagatggacatcggggtccccctgctcgcgctgggctgctacagccaggtgaaccccctgaccctcaccgccgccgtgctgatgctggtcgcccactacgccatcatcgggccgggcctccaggcgaaggccacgcgcgaggcccagaagcggaccgccgccgggatcatgaagaaccccaccatcgacggcatcgtggcgatcgacctggaccccgtggtctacgacgccaagttcgagaagcagctgggccagatcatgctcctgatcctgtgcacctcccagatcctcctgatgcgcacgacctgggccctgtgcgagagcatcaccctcgccaccgggcccctgacgaccctgtgggagggctccccggggaagttctggaacaccaccatcgccgtgagcatggcgaacatcttccgcggctcctacctcgccggcgccgggctggccttcagcctgatgaagtccctcggcgggggccggcgcgggacgggcgcgcagggcgagaccctgggggagaagtggaagcggcagctgaaccagctctccaagagcgagttcaacacctacaagcgctccggcatcatggaggtggaccggagcgaggccaaggaggggctgaagcgcggcgagaccacgaagcacgccgtctcccgggggaccgccaagctgcgctggttcgtggagcggaacctggtgaagcccgagggcaaggtcatcgacctcggctgcgggcgcggcgggtggagctactactgcgccggcctgaagaaggtgaccgaggtgaaggggtacaccaagggcggccccgggcacgaggagcccatcccgatggcgacgtacggctggaacctggtcaagctccactccgggaaggacgtgttcttcatcccgcccgagaagtgcgacaccctgctgtgcgacatcggcgagagctcccccaacccgaccatcgaggaggggcggaccctccgcgtgctgaagatggtcgagccctggctgcggggcaaccagttctgcatcaagatcctcaacccctacatgcccagcgtggtggagacgctggagcagatgcagcgcaagcacggcgggatgctggtccggaacccgctctcccgcaacagcacccacgagatgtactgggtgtcctgcggcaccgggaacatcgtgagcgccgtcaacatgacctcccggatgctgctgaaccgcttcaccatggcccaccggaagcccacgtacgagcgcgacgtggacctcggcgccggcacccgccacgtggccgtcgagcccgaggtggcgaacctggacatcatcgggcagcggatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctgctcacgaagccctgggacgtgatccccatggtgacccagatcgccatgaccgacaccacgcccttcgggcagcagcgcgtcttcaaggagaaggtggacacccggaccccgaaggccaagcgcggcaccgcgcagatcatggaggtgacggccaagtggctgtggggcttcctgtcccggaacaagaagccccgcatctgcacccgggaggagttcacccgcaaggtccggagcaacgccgccatcggggcggtgttcgtggacgagaaccagtggaactccgccaaggaggccgtcgaggacgaccgcttctgggacctcgtgcaccgggagcgcgagctgcacaagcagggcaagtgcgcgacctgcgtgtacaacatgatggggaagcgggagaagaagctgggcgagttcgggaaggccaagggcagccgcgcgatctggtacatgtggctcggcgcccggttcctggagttcgaggccctggggttcatgaacgaggaccactggttctcccgcgagaacagcctctccggcgtcgagggggagggcctgcacaagctggggtacatcctccgggacatcagcaagatccccggcggcaacatgtacgccgacgacacggccgggtgggacacccgcatcaccgaggacgacctgcagaacgaggcgaagatcaccgacatcatggagccggagcacgccctgctcgccaagtccatcttcaagctgacgtaccagaacaaggtggtgcgggtccagcgccccgccaagaacggcaccgtgatggacgtgatcagccggcgcgaccagcgcgggtccggccaggtcggcacctacgggctgaacaccttcacgaacatggaggcccagctcatccggcagatggagagcgagggcatcttctcccccaacgagctggagacccccaacctggcggagcgcgtgctcgactggctggagaagtacggggtggagcggctgaagcgcatggccatcagcggcgacgactgcgtcgtgaagccgatcgacgaccggttcgccaccgccctcaccgccctgaacgacatggggaaggtgcgcaaggacatcccccagtgggagccctccaagggctggaacgactggcagcaggtccccttctgcagccaccacttccaccagctgatcatgaaggacggccgggagatcgtggtgccgtgccgcaaccaggacgagctcgtcgggcgggcgcgcgtgtcccagggcgccgggtggagcctgcgggagacggcctgcctgggcaagagctacgcccagatgtggcagctcatgtacttccaccgccgggacctgcgcctggcggccaacgccatctgctccgccgtgcccgtcgactgggtgcccaccagccggaccacctggtccatccacgcccaccaccagtggatgacgaccgaggacatgctcagcgtgtggaaccgcgtctggatcgaggagaacccctggatggaggacaagacccggatctccagctgggaggacgtgccgtacctggggaagcgcgaggaccagtggtgcggctccctgatcggcctcaccgcgcgggccacgtgggccaccaacatccaggtggccatcaaccaggtccgccgcctgatcgggaacgagaactacagcgactacatgacctccatgaagcggttcaagaacgagagcgagcccgagggcgccctgtggtga

SEQ ID NO: 8196 - RNA, 9879 nt, synthetic construct
  misc_feature 1..9879: note = derived and/or modified CDS sequence (opt1) from DENV-1__FJ687428__SS-prME
  source 1..9879: mol_type = other RNA
agcgtgaccatgctgctcatgctgatgcccaccgccctggccttccacctcaccacccggggcggggagccccacatgatcgtcagcaagcaggagcggggcaagagcctgctgttcaagaccagcgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagtacaagtacagctggaagtcctggggcaaggccaagatcatcggcgccgacgtgcagaacagcacgttcatcatcgacgggcccaacaccccggagtgccccgacgaccagcgcgcgtggaacatctgggaggtcgaggactacggcttcgggatcttcaccaccaacatctggctgaagctccgggactcctacacccaggtgtgcgaccaccgcctgatgagcgccgccatcaaggactccaaggccgtgcacgccgacatgggctactggatcgagagcgagaagaacgagacctggaagctggcgggcgcctccttcatcgaggtcaagacctgcatctggcccaagagccacaccctctggtccaacggggtgctggagagcgagatgatcatccccaagatctacggcgggccgatctcccagcacaactaccggcccggctacttcacgcagaccgccgggccctggcacctgggcaagctcgagctggacttcgacctgtgcgagggcaccaccgtggtcgtggacgagcactgcgggaaccgcggcccgagcctccggacgaccaccgtgaccgggaagatcatccacgagtggtgctgccgctcctgcacgctgccgcccctgcggttccgcggcgaggacgggtgctggtacggcatggagatccggcccgtcaaggagaaggaggagaacctcgtgaagtccatggtgagcgccggctccggggaggtcgacagcttctccctgggcctgctctgcatcagcatcatgatcgaggaggtgatgcgctcccggtggagccgcaagatgctgatgaccgggaccctggccgtgttcttcctcctgatcatgggccagctgacctggaacgacctcatccggctgtgcatcatggtcggggcgaacgcctccgaccgcatgggcatgggcacgacctacctggccctcatggccaccttcaagatgcgcccgatgttcgccgtggggctgctgttccggcgcctcaccagccgggaggtgctgctgctcacgatcggcctgtccctggtcgcgagcgtggagctccccaactccctggaggagctgggggacggcctcgccatgggcatcatgatcctgaagctgctcaccgacttccagagccaccagctgtgggccaccctgctctccctgaccttcatcaagacgaccctgagcctccactacgcctggaagaccatggcgatggtcctgtccatcgtgagcctgttccccctctgcctgtccaccacgagccagaagaccacctggctgcccgtgctcctggggtccctgggctgcaagccgctcaccatgttcctgatcgccgagaacaagatctgggggcgcaagagctggcccctgaacgagggcatcatggccgtcgggatcgtgagcatcctcctgtccagcctgctcaagaacgacgtgcccctggccggccccctgatcgccggcgggatgctcatcgcgtgctacgtcatctccggcagctccgccgacctgagcctggagaaggccgccgaggtgtcctgggaggaggaggccgagcacagcggggcgtcccacaacatcctcgtggaggtccaggacgacggcacgatgaagatcaaggacgaggagcgggacgacaccctgaccatcctgctcaaggccaccctgctggccgtgagcggggtgtacccgctctccatccccgccaccctgttcgtctggtacttctggcagaagaagaagcagcgcagcggcgtgctgtgggacacgcccagcccgcccgaggtggagcgggccgtcctggacgacggcatctaccgcatcatgcagcgggggctcctgggccgcagccaggtgggggtgggcgtcttccaggagaacgtgttccacaccatgtggcacgtgacccgcggggccgtcctgatgtaccagggcaagcgcctcgagccctcctgggccagcgtgaagaaggacctgatctcctacggcgggggctggcggctgcaggggagctggaacaccggcgaggaggtgcaggtcatcgccgtggagcccgggaagaaccccaagaacgtgcagacggcccccggcaccttcaagacccccgagggcgaggtcggggccatcgcgctcgacttcaagcccggcacctccgggagccccatcgtgaaccgcgagggcaagatcgtgggcctgtacgggaacggcgtcgtgacgaccagcgggacctacgtgtccgccatcgcccaggccaaggcgagccaggagggcccgctgcccgagatcgaggacgaggtcttccggaagcgcaacctcaccatcatggacctgcaccccgggtccggcaagacgcggcgctacctgccggccatcgtgcgggaggccatcaagcgcaagctccggaccctgatcctggcccccacccgcgtggtcgccagcgagatggcggaggccctcaagggcatgcccatccgctaccagaccacggccgtgaagtccgagcacaccgggaaggagatcgtggacctgatgtgccacgccaccttcaccatgcggctgctcagccccgtccgcgtgccgaactacaacatgatcatcatggacgaggcccacttcacggacccctccagcatcgcggcccggggctacatctccacccgcgtggggatgggcgaggccgccgccatcttcatgaccgcgacgccgcccgggagcgtcgaggccttcccgcagtccaacgccgtgatccaggacgaggagcgggacatccccgagcgcagctggaactccggctacgagtggatcacggacttccccggcaagaccgtgtggttcgtccccagcatcaaggccgggaacgacatcgcgaactgcctgcggaagaacggcaagcgcgtgatccagctgtcccggaagaccttcgacaccgagtaccagaagacgaagaacaacgactgggactacgtggtcaccaccgacatcagcgagatgggggccaacttccgcgccgaccgggtgatcgacccgcgccggtgcctcaagcccgtgatcctgaaggacggccccgagcgcgtcatcctggccgggcccatgccggtgaccgtcgcctccgcggcccagcggcgcggccggatcggccgcaaccacaacaaggagggggaccagtacatctacatgggccagcccctcaacaacgacgaggaccacgcccactggacggaggccaagatgctgctggacaacatcaacacccccgaggggatcatccccgccctcttcgagccggagcgggagaagtccgcggccatcgacggcgagtaccgcctgcgcggggaggcccggaagaccttcgtggagctgatgcgccggggcgacctccccgtgtggctgtcctacaaggtcgccagcgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacgtactccgaccccctggcgctccgggagttcaaggagttcgccgccgggcgccggagcgtctccggcgacctgatcctggagatcggcaagctcccgcagcacctgacccagcgcgcccagaacgcgctggacaacctcgtgatgctgcacaacagcgagcagggcgggcgggcctaccgccacgccatggaggagctgcccgacaccatcgagaccctcatgctgctggccctcatcgccgtgctgaccgggggcgtcaccctgttcttcctctccgggaagggcctgggcaagaccagcatcgggctgctctgcgtgatggcgtccagcgtgctgctgtggatggcctccgtcgagccccactggatcgccgccagcatcatcctcgagttcttcctgatggtgctgctcatccccgagccggaccggcagcgcacgccccaggacaaccagctggcctacgtggtcatcggcctcctgttcatgatcctgaccgtggcggccaacgagatggggctgctcgagacgaccaagaaggacctgggcatcgggcacgtggccgtcgagaaccaccaccacgccgccatgctggacgtggacctccaccccgcgtccgcctggaccctgtacgccgtggccaccacgatcatcaccccgatgatgcggcacaccatcgagaacaccacggccaacatcagcctgaccgcgatcgccaaccaggccgccatcctcatgggcctggacaagggctggcccatctccaagatggacatcggggtccccctgctcgcgctgggctgctacagccaggtgaaccccctgaccctcaccgccgccgtgctgatgctggtcgcccactacgccatcatcgggccgggcctccaggcgaaggccacgcgcgaggcccagaagcggaccgccgccgggatcatgaagaaccccaccatcgacggcatcgtggcgatcgacctggaccccgtggtctacgacgccaagttcgagaagcagctgggccagatcatgctcctgatcctgtgcacctcccagatcctcctgatgcgcacgacctgggccctgtgcgagagcatcaccctcgccaccgggcccctgacgaccctgtgggagggctccccggggaagttctggaacaccaccatcgccgtgagcatggcgaacatcttccgcggctcctacctcgccggcgccgggctggccttcagcctgatgaagtccctcggcgggggccggcgcgggacgggcgcgcagggcgagaccctgggggagaagtggaagcggcagctgaaccagctctccaagagcgagttcaacacctacaagcgctccggcatcatggaggtggaccggagcgaggccaaggaggggctgaagcgcggcgagaccacgaagcacgccgtctcccgggggaccgccaagctgcgctggttcgtggagcggaacctggtgaagcccgagggcaaggtcatcgacctcggctgcgggcgcggcgggtggagctactactgcgccggcctgaagaaggtgaccgaggtgaaggggtacaccaagggcggccccgggcacgaggagcccatcccgatggcgacgtacggctggaacctggtcaagctccactccgggaaggacgtgttcttcatcccgcccgagaagtgcgacaccctgctgtgcgacatcggcgagagctcccccaacccgaccatcgaggaggggcggaccctccgcgtgctgaagatggtcgagccctggctgcggggcaaccagttctgcatcaagatcctcaacccctacatgcccagcgtggtggagacgctggagcagatgcagcgcaagcacggcgggatgctggtccggaacccgctctcccgcaacagcacccacgagatgtactgggtgtcctgcggcaccgggaacatcgtgagcgccgtcaacatgacctcccggatgctgctgaaccgcttcaccatggcccaccggaagcccacgtacgagcgcgacgtggacctcggcgccggcacccgccacgtggccgtcgagcccgaggtggcgaacctggacatcatcgggcagcggatcgagagcatcaagcacgagcacaagtccacctggcactacgacgaggacaacccctacaagacctgggcctaccacggcagctacgaggtgaagccgtccgggagcgccagctccatggtcaacggcgtggtcaagctgctcacgaagccctgggacgtgatccccatggtgacccagatcgccatgaccgacaccacgcccttcgggcagcagcgcgtcttcaaggagaaggtggacacccggaccccgaaggccaagcgcggcaccgcgcagatcatggaggtgacggccaagtggctgtggggcttcctgagccggaacaagaagccccgcatctgcacccgggaggagttcacccgcaaggtccggtccaacgccgccatcggggcggtgttcgtggacgagaaccagtggaacagcgccaaggaggccgtcgaggacgaccgcttctgggacctcgtgcaccgggagcgcgagctgcacaagcagggcaagtgcgcgacctgcgtgtacaacatgatggggaagcgggagaagaagctgggcgagttcgggaaggccaagggctcccgcgcgatctggtacatgtggctcggcgcccggttcctggagttcgaggccctggggttcatgaacgaggaccactggttcagccgcgagaactccctcagcggcgtcgagggggagggcctgcacaagctggggtacatcctccgggacatctccaagatccccggcggcaacatgtacgccgacgacacggccgggtgggacacccgcatcaccgaggacgacctgcagaacgaggcgaagatcaccgacatcatggagccggagcacgccctgctcgccaagagcatcttcaagctgacgtaccagaacaaggtggtgcgggtccagcgccccgccaagaacggcaccgtgatggacgtgatctcccggcgcgaccagcgcgggagcggccaggtcggcacctacgggctgaacaccttcacgaacatggaggcccagctcatccggcagatggagtccgagggcatcttcagccccaacgagctggagacccccaacctggcggagcgcgtgctcgactggctggagaagtacggggtggagcggctgaagcgcatggccatctccggcgacgactgcgtcgtgaagccgatcgacgaccggttcgccaccgccctcaccgccctgaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctcgtcgggcgggcgcgcgtgagccagggcgccgggtggagcctgcgggagacggcctgcctgggcaagtcctacgcccagatgtggcagctcatgtacttccaccgccgggacctgcgcctggcggccaacgccatctgcagcgccgtgcccgtcgactgggtgcccacctcccggaccacctggagcatccacgcccaccaccagtggatgacgaccgaggacatgctctccgtgtggaaccgcgtctggatcgaggagaacccctggatggaggacaagacccggatcagctcctgggaggacgtgccgtacctggggaagcgcgaggaccagtggtgcggcagcctgatcggcctcaccgcgcgggccacgtgggccaccaacatccaggtggccatcaaccaggtccgccgcctgatcgggaacgagaactactccgactacatgaccagcatgaagcggttcaagaacgagtccgagcccgagggcgccctgtggtga

SEQ ID NO: 8197 - RNA, 9879 nt, synthetic construct
  misc_feature 1..9879: note = derived and/or modified CDS sequence (opt1) from DENV-1__FJ687429__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtcacctacgggacctgcagccagaccggcgagcaccggcgggacaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtggatcgacgtggtcctggagcacgggagctgcatcaccaccatggccaaggacaagcccaccctggacatcgagctcctgaagacggaggtgaccaaccccgcggtgctgcggaagctctgcatcgaggccaagatctccaacaccaccacggacagccgctgcccgacccagggcgaggccaccctggtcgaggagcaggacgccaacttcgtgtgccggcgcaccttcgtggaccggggctgggggaacggctgcgggctgttcggcaaggggtccctcctgacgtgcgccaagttcaagtgcgtcaccaagctggagggcaagatcgtgcagtacgagaacctcaagtacagcgtgatcgtcaccgtgcacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtcaccttcaagaccgcccacgcgaagaagcaggaggtggtggtcctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtgatgtgcaccgggtccttcaagctggagaaggaggtggcggagacgcagcacggcaccgtcctggtgcagatcaagtacgagggcaccgacgccccctgcaagatccccttcagcacccaggacgagaagggggtgacgcagaacggccggctgatcaccgccaacccgatcgtcaccgacaaggagaagcccgtgaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtcttcaccagcgtggggaagctcgtgcaccagatcttcggcaccgcctacggggtcctgttctccggcgtgagctggaccatgaagatcgggatcggcgtgctgctcacgtggctgggcctgaactcccgcagcacctccctcagcatgacctgcatcgccgtcgggctggtgaccctgtacctcggcgtgatggtccaggccgactccgggtgcgtgatcaactggaagggccgggagctgaagtgcgggagcggcatcttcgtgacgaacgaggtccacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcaccgtggtcgtgggggacgtggcgggcatcctggcccaggggaagaagatgatccggccccagcccatggagtacaagtacagctggaagtcctggggcaaggccaagatcatcggcgccgacgtccagaacagcacgttcatcatcgacgggcccaacaccccggagtgccccgacgaccagcgcgcgtggaacatctgggaggtggaggactacggcttcgggatcttcaccaccaacatctggctgaagctccgggactcctacacccaggtgtgcgaccaccgcctgatgagcgccgccatcaaggactccaaggccgtccacgccgacatgggctactggatcgagagcgagaagaacgagacctggaagctggcgcgggcctccttcatcgaggtgaagacctgcatctggcccaagagccacaccctctggtccaacggcgtgctggagagcgagatgatcatccccaagatctacgggggcccgatctcccagcacaactaccgccccgggtacttcacgcagaccgccggcccctggcacctggggaagctcgagctggacttcgacctgtgcgagggcaccaccgtcgtggtggacgagcactgcggcaaccgggggccgagcctccgcacgaccaccgtcaccggcaagatcatccacgagtggtgctgccggtcctgcacgctgccgcccctgcgcttccgcggggaggacggctgctggtacgggatggagatccgccccgtgaaggagaaggaggagaacctcgtgaagtccatggtcagcgccggctccggcgaggtggacagcttctccctggggctgctctgcatcagcatcatgatcgaggaggtgatgcggtcccgctggagccggaagatgctgatgaccggcaccctggccgtcttcttcctcctgatcatggggcagctgacctggaacgacctcatccgcctgtgcatcatggtgggcgcgaacgcctccgaccgcatggggatgggcacgacctacctggccctcatggccaccttcaagatgcggccgatgttcgccgtgggcctgctgttccgccggctcaccagccgcgaggtcctgctgctcacgatcgggctgtccctggtggcgagcgtggagctccccaactccctggaggagctgggcgacgggctcgccatgggcatcatgatcctgaagctgctcaccgacttccagagccaccagctgtgggccaccctgctctccctgaccttcatcaagacgaccttcagcctgcactacgcctggaagaccatggcgatggtcctctccatcgtgagcctgttccccctgtgcctctccaccacgagccagaagaccacctggctgcccgtcctgctcggctccctggggtgcaagccgctgaccatgttcctcatcgccgagaacaagatctggggccgcaagagctggcccctgaacgaggggatcatggccgtgggcatcgtgagcatcctgctctccagcctgctgaagaacgacgtccccctcgccgggcccctgatcgccggcggcatgctgatcgcgtgctacgtgatctccgggagctccgccgacctcagcctggagaaggccgccgaggtgtcctgggaggaggaggccgagcacagcggcgcgtcccacaacatcctggtcgaggtgcaggacgacgggacgatgaagatcaaggacgaggagcgcgacgacaccctcaccatcctgctgaaggccaccctcctggccgtgagcggcgtctacccgctgtccatccccgccaccctcttcgtgtggtacttctggcagaagaagaagcagcggagcggggtgctgtgggacacgcccagcccgcccgaggtcgagcgcgccgtgctggacgacggcatctaccggatcatgcagcgcggcctgctcgggcggagccaggtgggcgtcggggtgttccaggagaacgtgttccacaccatgtggcacgtcacccgcggcgcggtgctgatgtaccaggggaagcggctggagccctcctgggccagcgtgaagaaggacctcatctcctacggcggcgggtggcgcctgcagggcagctggaacaccggggaggaggtccaggtgatcgccgtggagcccggcaagaaccccaagaacgtccagacggcccccgggaccttcaagacccccgagggcgaggtgggcgccatcgcgctggacttcaagcccgggacctccggcagccccatcgtgaaccgggaggggaagatcgtcggcctctacggcaacggggtggtgacgaccagcggcacctacgtctccgccatcgcccaggccaaggcgagccaggaggggccgctgcccgagatcgaggacgaggtgttccgcaagcggaacctgaccatcatggacctccaccccggctccgggaagacgcgccggtacctgccggccatcgtgcgcgaggccatcaagcggaagctgcgcaccctcatcctggcccccacccgcgtcgtggccagcgagatggcggaggccctgaagggcatgcccatccggtaccagaccacggccgtgaagtccgagcacaccggcaaggagatcgtcgacctcatgtgccacgccaccttcaccatgcgcctgctgagccccgtgcgggtgccgaactacaacatgatcatcatggacgaggcccacttcacggacccctccagcatcgcggcccgcgggtacatctccacccgggtcggcatgggggaggccgccgccatcttcatgaccgcgacgccgcccggcagcgtggaggccttcccgcagtccaacgccgtgatccaggacgaggagcgcgacatccccgagcggagctggaactccgggtacgagtggatcacggacttccccggcaagaccgtctggttcgtgcccagcatcaaggccggcaacgacatcgcgaactgcctccgcaagaacgggaagcgggtgatccagctgtcccgcaagaccttcgacaccgagtaccagaagacgaagaacaacgactgggactacgtcgtgaccaccgacatcagcgagatgggcgccaacttccgggccgaccgcgtgatcgacccgcggcgctgcctgaagcccgtcatcctcaaggacgggcccgagcgggtgatcctggccggccccatgccggtgaccgtcgcctccgcggcccagcgccgggggcgcatcggccggaaccacaacaaggagggcgaccagtacatctacatggggcagcccctgaacaacgacgaggaccacgcccactggacggaggccaagatgctcctggacaacatcaacacccccgagggcatcatccccgccctgttcgagccggagcgcgagaagtccgcggccatcgacggggagtaccgcctccggggcgaggcccgcaagaccttcgtggagctgatgcggcgcggggacctgcccgtctggctctcctacaaggtggccagcgagggcttccagtacagcgaccggcgctggtgcttcgacggcgagcggaacaaccaggtgctggaggagaacatggacgtcgagatctggaccaaggagggggagcgcaagaagctgcggccccgctggctcgacgcccggacgtactccgaccccctggcgctgcgcgagttcaaggagttcgccgccggccggcgcagcgtgtccggggacctcatcctggagatcggcaagctgccgcagcacctcacccagcgggcccagaacgcgctggacaacctggtgatgctccacaacagcgagcagggcgggcgcgcctaccggcacgccatggaggagctgcccgacaccatcgagaccctgatgctcctggccctgatcgccgtcctcacgggcggggtgaccctgttcttcctgtccggcaaggggctcggcaagaccagcatcggcctgctgtgcgtgatggcgtccagcgtcctcctgtggatggcctccgtggagccccactggatcgccgccagcatcatcctggagttcttcctcatggtgctgctgatccccgagccggaccgccagcggacgccccaggacaaccagctcgcctacgtcgtgatcgggctgctgttcatgatcctcaccgtggcggccaacgagatgggcctgctggagacgaccaagaaggacctcgggatcggccacgtcgccgtggagaaccaccaccacgccgccatgctggacgtggacctgcaccccgcgtccgcctggaccctctacgccgtcgccaccacgatcatcaccccgatgatgcgccacaccatcgagaacaccacggccaacatcagcctgaccgcgatcgccaaccaggccgccatcctgatggggctcgacaagggctggcccatctccaagatggacatcggcgtgcccctgctggcgctcgggtgctacagccaggtgaaccccctgaccctgaccgccgccgtcctcatgctggtggcccactacgccatcatcggcccggggctgcaggcgaaggccacgcgggaggcccagaagcgcaccgccgccggcatcatgaagaaccccaccatcgacgggatcgtggcgatcgacctcgaccccgtcgtgtacgacgccaagttcgagaagcagctgggccagatcatgctgctcatcctgtgcacctcccagatcctgctcatgcgcacgacctgggccctgtgcgagagcatcaccctggccaccggccccctcacgaccctgtgggaggggtccccgggcaagttctggaacaccaccatcgccgtgagcatggcgaacatcttccgggggtcctacctggccggcgccggcctcgccttcagcctgatgaagtccctcgggggcgggcgccgggggacgggggcgcagggcgagaccctcggcgagaagtggaagcgccagctgaaccagctgtccaagagcgagttcaacacctacaagcggtccgggatcatggaggtcgaccgcagcgaggccaaggagggcctcaagcgcggggagaccacgaagcacgccgtgtcccgcggcaccgccaagctgcggtggttcgtggagcgcaacctggtcaagcccgaggggaaggtgatcgacctgggctgcggccgcggcgggtggagctactactgcgccgggctcaagaaggtgaccgaggtcaaggggtacaccaagggcggccccggccacgaggagcccatcccgatggcgacgtacgggtggaacctggtgaagctgcactccggcaaggacgtgttcttcatcccgcccgagaagtgcgacaccctcctgtgcgacatcggggagagctcccccaacccgaccatcgaggagggccgcaccctgcgggtcctcaagatggtggagccctggctgcgcgggaaccagttctgcatcaagatcctgaacccctacatgcccagcgtggtcgagacgctcgagcagatgcagcggaagcacggcggcatgctggtgcgcaacccgctgtcccggaacagcacccacgagatgtactgggtgtcctgcgggaccggcaacatcgtcagcgccgtgaacatgacctcccgcatgctcctgaaccggttcaccatggcccaccgcaagcccacgtacgagcgcgacgtggacctgggggccggcacccggcacgtcgccgtggagcccgaggtggcgaacctcgacatcatcggccagcgcatcgagaacatcaagcacgagcacaagagcacctggcactacgacgaggacaacccctacaagacctgggcctaccacgggtcctacgaggtcaagccgagcggctccgccagcagcatggtgaacggggtggtcaagctgctgacgaagccctgggacgtgatccccatggtcacccagatcgccatgaccgacaccacgcccttcggccagcagcgggtgttcaaggagaaggtggacacccgcaccccgaaggccaagcgggggaccgcgcagatcatggaggtcacggcccgctggctctggggcttcctgtcccggaacaagaagccccgcatctgcacccgggaggagttcacccgcaaggtgcggagcaacgccgccatcggcgcggtgttcgtcgacgagaaccagtggaactccgccaaggaggccgtggaggacgaccgcttctgggacctggtgcaccgggagcgcgagctccacaagcaggggaagtgcgcgacctgcgtctacaacatgatgggcaagcgggagaagaagctgggggagttcggcaaggccaaggggagccgcgcgatctggtacatgtggctgggcgcccggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgccgacgacacggccggctgggacacccgcatcaccgaggacgacctccagaacgaggcgaagatcaccgacatcatggagccggagcacgccctgctggccaagtccatcttcaagctcacgtaccagaacaaggtggtccgggtgcagcgccccgccaagaacgggaccgtgatggacgtcatcagccgccgggaccagcgcggctccggccaggtggggacctacggcctgaacaccttcacgaacatggaggcccagctgatccggcagatggagagcgaggggatcttctcccccaacgagctcgagacccccaacctggcggagcgcgtgctggactggctcgagaagtacggcgtcgagcggctgaagcgcatggccatcagcggggacgactgcgtggtgaagccgatcgacgaccggttcgccaccgccctgaccgccctcaacgacatgggcaaggtccgcaaggacatcccccagtgggagccctccaaggggtggaacgactggcagcaggtccccttctgcagccaccacttccaccagctgatcatgaaggacggccgggagatcgtggtcccgtgccgcaaccaggacgagctggtgggccgggcgcgcgtgtcccagggggccggctggagcctccgggagacggcctgcctgggcaagagctacgcccagatgtggcagctgatgtacttccaccgccgggacctccgcctggcggccaacgccatctgctccgccgtccccgtggactgggtgcccaccagccggaccacctggtccatccacgcccaccaccagtggatgacgaccgaggacatgctgagcgtctggaaccgcgtgtggatcgaggagaacccctggatggaggacaagacccggatctccagctgggaggacgtgccgtacctcggcaagcgcgaggaccagtggtgcgggtccctgatcggcctgaccgcgcgcgccacgtgggccaccaacatccaggtcgccatcaaccaggtgcggcgcctcatcggcaacgagaactacagcgactacatgacctccatgaagcggttcaagaacgagagcgagcccgagggggccctgtggtga

SEQ ID NO: 8198 - RNA, 9879 nt, synthetic construct
  misc_feature 1..9879: note = derived and/or modified CDS sequence (opt1) from DENV-1__FJ850068__SS-prME
  source 1..9879: mol_type = other RNA
agcgtgaccatgctgctcatgctgatgcccaccgccctggccttccacctcaccacccggggcggggagccccacatgatcgtcagcaagcaggagcggggcaagagcctgctgttcaagaccagcgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagtacaagtacagctggaagtcctggggcaaggccaagatcatcggcgccgacgtgcagaacagcacgttcatcatcgacgggcccaacaccccggagtgccccgacgaccagcgcgcgtggaacatctgggaggtcgaggactacggcttcgggatcttcaccaccaacatctggctgaagctccgggactcctacacccaggtgtgcgaccaccgcctgatgagcgccgccatcaaggactccaaggccgtgcacgccgacatgggctactggatcgagagcgagaagaacgagacctggaagctggcgggcgcctccttcatcgaggtcaagacctgcatctggcccaagagccacaccctctggtccaacggggtgctggagagcgagatgatcatccccaagatctacggcgggccgatctcccagcacaactaccggcccggctacttcacgcagaccgccgggccctggcacctgggcaagctcgagctggacttcgacctgtgcgagggcaccaccgtggtcgtggacgagcactgcgggaaccgcggcccgagcctccggacgaccaccgtgaccgggaagatcatccacgagtggtgctgccgctcctgcacgctgccgcccctgcggttccgcggcgaggacgggtgctggtacggcatggagatccggcccgtcaaggagaaggaggagaacctcgtgaagtccatggtgagcgccggctccggggaggtcgacagcttctccctgggcctgctctgcatcagcatcatgatcgaggaggtgatgcgctcccggtggagccgcaagatgctgatgaccgggaccctggccgtgttcttcctcctgatcatgggccagctgacctggaacgacctcatccggctgtgcatcatggtcggggcgaacgcctccgaccgcatgggcatgggcacgacctacctggccctcatggccaccttcaagatgcgcccgatgttcgccgtggggctgctgttccggcgcctcaccagccgggaggtgctgctgctcacgatcggcctgtccctggtcgcgagcgtggagctccccaactccctggaggagctgggggacggcctcgccatgggcatcatgatcctgaagctgctcaccgacttccagagccaccagctgtgggccaccctgctctccctgaccttcatcaagacgaccttcagcctgcactacgcctggaagaccatggcgatggtcctctccatcgtgagcctgttccccctgtgcctctccaccacgagccagaagaccacctggctgcccgtgctgctcgggtccctgggctgcaagccgctgaccatgttcctcatcgccgagaacaagatctgggggcgcaagagctggcccctgaacgagggcatcatggccgtcgggatcgtgagcatcctgctctccagcctgctgaagaacgacgtgcccctcgccggccccctgatcgccggcgggatgctgatcgcgtgctacgtcatctccggcagctccgccgacctcagcctggagaaggccgccgaggtgtcctgggaggaggaggccgagcacagcggggcgtcccacaacatcctggtggaggtccaggacgacggcacgatgaagatcaaggacgaggagcgggacgacaccctcaccatcctgctgaaggccaccctcctggccgtgagcggggtgtacccgctgtccatccccgccaccctcttcgtctggtacttctggcagaagaagaagcagcgcagcggcgtgctgtgggacacgcccagcccgcccgaggtggagcgggccgtcctggacgacggcatctaccgcatcatgcagcgggggctgctcggccgcagccaggtgggggtgggcgtcttccaggagaacgtgttccacaccatgtggcacgtgacccgcggggccgtcctgatgtaccagggcaagcgcctggagccctcctgggccagcgtgaagaaggacctcatctcctacggcgggggctggcggctgcaggggagctggaacaccggcgaggaggtgcaggtcatcgccgtggagcccgggaagaaccccaagaacgtgcagacggcccccggcaccttcaagacccccgagggcgaggtcggggccatcgcgctggacttcaagcccggcacctccgggagccccatcgtgaaccgcgagggcaagatcgtgggcctctacgggaacggcgtcgtgacgaccagcgggacctacgtgtccgccatcgcccaggccaaggcgagccaggagggcccgctgcccgagatcgaggacgaggtcttccggaagcgcaacctgaccatcatggacctccaccccgggtccggcaagacgcggcgctacctgccggccatcgtgcgggaggccatcaagcgcaagctgcggaccctcatcctggcccccacccgcgtggtcgccagcgagatggcggaggccctgaagggcatgcccatccgctaccagaccacggccgtgaagtccgagcacaccgggaaggagatcgtggacctcatgtgccacgccaccttcaccatgcggctgctgagccccgtccgcgtgccgaactacaacatgatcatcatggacgaggcccacttcacggacccctccagcatcgcggcccggggctacatctccacccgcgtggggatgggcgaggccgccgccatcttcatgaccgcgacgccgcccgggagcgtcgaggccttcccgcagtccaacgccgtgatccaggacgaggagcgggacatccccgagcgcagctggaactccggctacgagtggatcacggacttccccggcaagaccgtgtggttcgtccccagcatcaaggccgggaacgacatcgcgaactgcctccggaagaacggcaagcgcgtgatccagctgtcccggaagaccttcgacaccgagtaccagaagacgaagaacaacgactgggactacgtggtcaccaccgacatcagcgagatgggggccaacttccgcgccgaccgggtgatcgacccgcgccggtgcctgaagcccgtgatcctcaaggacggccccgagcgcgtcatcctggccgggcccatgccggtgaccgtcgcctccgcggcccagcggcgcggccggatcggccgcaaccacaacaaggagggggaccagtacatctacatgggccagcccctgaacaacgacgaggaccacgcccactggacggaggccaagatgctcctggacaacatcaacacccccgaggggatcatccccgccctgttcgagccggagcgggagaagtccgcggccatcgacggcgagtaccgcctccgcggggaggcccggaagaccttcgtggagctgatgcgccggggcgacctgcccgtgtggctctcctacaaggtcgccagcgagggcttccagtacagcgaccgccggtggtgcttcgacggggagcgcaacaaccaggtgctggaggagaacatggacgtggagatctggaccaaggagggcgagcggaagaagctgcgcccccggtggctcgacgcccgcacgtactccgaccccctggcgctgcgggagttcaaggagttcgccgccgggcgccggagcgtctccggcgacctcatcctggagatcggcaagctgccgcagcacctcacccagcgcgcccagaacgcgctggacaacctggtgatgctccacaacagcgagcagggcgggcgggcctaccgccacgccatggaggagctgcccgacaccatcgagaccctgatgctcctggccctgatcgccgtgctcaccgggggcgtcaccctgttcttcctgtccgggaagggcctcggcaagaccagcatcgggctgctgtgcgtgatggcgtccagcgtgctcctgtggatggcctccgtcgagccccactggatcgccgccagcatcatcctggagttcttcctcatggtgctgctgatccccgagccggaccggcagcgcacgccccaggacaaccagctcgcctacgtggtcatcggcctgctgttcatgatcctcaccgtggcggccaacgagatggggctgctggagacgaccaagaaggacctcggcatcgggcacgtggccgtcgagaaccaccaccacgccgccatgctggacgtggacctgcaccccgcgtccgcctggaccctctacgccgtggccaccacgatcatcaccccgatgatgcggcacaccatcgagaacaccacggccaacatcagcctgaccgcgatcgccaaccaggccgccatcctgatgggcctcgacaagggctggcccatctccaagatggacatcggggtccccctgctggcgctcggctgctacagccaggtgaaccccctgaccctgaccgccgccgtgctcatgctggtcgcccactacgccatcatcgggccgggcctgcaggcgaaggccacgcgcgaggcccagaagcggaccgccgccgggatcatgaagaaccccaccatcgacggcatcgtggcgatcgacctcgaccccgtggtctacgacgccaagttcgagaagcagctgggccagatcatgctgctcatcctgtgcacctcccagatcctgctcatgcgcacgacctgggccctgtgcgagagcatcaccctggccaccgggcccctcacgaccctgtgggagggctccccggggaagttctggaacaccaccatcgccgtgagcatggcgaacatcttccgcggctcctacctggccggcgccgggctcgccttcagcctgatgaagtccctgggcgggggccggcgcgggacgggcgcgcagggcgagaccctcggggagaagtggaagcggcagctgaaccagctgtccaagagcgagttcaacacctacaagcgctccggcatcatggaggtggaccggagcgaggccaaggaggggctcaagcgcggcgagaccacgaagcacgccgtctcccgggggaccgccaagctgcgctggttcgtggagcggaacctggtgaagcccgagggcaaggtcatcgacctgggctgcgggcgcggcgggtggagctactactgcgccggcctcaagaaggtgaccgaggtgaaggggtacaccaagggcggccccgggcacgaggagcccatcccgatggcgacgtacggctggaacctggtcaagctgcactccgggaaggacgtgttcttcatcccgcccgagaagtgcgacaccctcctgtgcgacatcggcgagagctcccccaacccgaccatcgaggaggggcggaccctgcgcgtgctcaagatggtcgagccctggctgcggggcaaccagttctgcatcaagatcctgaacccctacatgcccagcgtggtggagacgctcgagcagatgcagcgcaagcacggcgggatgctggtccggaacccgctgtcccgcaacagcacccacgagatgtactgggtgtcctgcggcaccgggaacatcgtgagcgccgtcaacatgacctcccggatgctcctgaaccgcttcaccatggcccaccggaagcccacgtacgagcgcgacgtggacctgggcgccggcacccgccacgtggccgtcgagcccgaggtggcgaacctcgacatcatcgggcagcggatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctgctgacgaagccctgggacgtgatccccatggtgacccagatcgccatgaccgacaccacgcccttcgggcagcagcgcgtcttcaaggagaaggtggacacccggaccccgaaggccaagcgcggcaccgcgcagatcatggaggtgacggcccggtggctctggggcttcctgtcccgcaacaagaagccccggatctgcacccgcgaggagttcacccggaaggtccgcagcaacgccgccatcggggcggtgttcgtggacgagaaccagtggaactccgccaaggaggccgtcgaggacgaccggttctgggacctggtgcaccgcgagcgggagctccacaagcagggcaagtgcgcgacctgcgtgtacaacatgatggggaagcgcgagaagaagctgggcgagttcgggaaggccaagggcagccgggcgatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgccgacgacacggccgggtgggacacccggatcaccgaggacgacctccagaacgaggcgaagatcaccgacatcatggagccggagcacgccctgctggccaagtccatcttcaagctcacgtaccagaacaaggtggtgcgcgtccagcggcccgccaagaacggcaccgtgatggacgtgatcagccgccgcgaccagcgggggtccggccaggtcggcacctacgggctgaacaccttcacgaacatggaggcccagctgatccgccagatggagagcgagggcatcttctcccccaacgagctcgagacccccaacctggcggagcgggtgctggactggctcgagaagtacggggtggagcgcctgaagcggatggccatcagcggcgacgactgcgtcgtgaagccgatcgacgaccgcttcgccaccgccctgaccgccctcaacgacatggggaaggtgcggaaggacatcccccagtgggagccctccaagggctggaacgactggcagcaggtccccttctgcagccaccacttccaccagctgatcatgaaggacggccgcgagatcgtggtgccgtgccggaaccaggacgagctggtcgggcgcgcgcgggtgtcccagggcgccgggtggagcctccgcgagacggcctgcctgggcaagagctacgcccagatgtggcagctgatgtacttccaccggcgcgacctccggctggcggccaacgccatctgctccgccgtgcccgtcgactgggtgcccaccagccgcaccacctggtccatccacgcccaccaccagtggatgacgaccgaggacatgctgagcgtgtggaaccgggtctggatcgaggagaacccctggatggaggacaagacccgcatctccagctgggaggacgtgccgtacctcgggaagcgggaggaccagtggtgcggctccctgatcggcctgaccgcgcgcgccacgtgggccaccaacatccaggtggccatcaaccaggtccgccggctcatcgggaacgagaactacagcgactacatgacctccatgaagcgcttcaagaacgagagcgagcccgagggcgccctgtggtga

SEQ ID NO: 8199 - RNA, 9879 nt, synthetic construct
  misc_feature 1..9879: note = derived and/or modified CDS sequence (opt1) from DENV-1__FJ687430__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccaccggggtgaacatgtgcaccctcatcgccatggacctgggcgagctgtgcgaggacaccatgacctacaagtgcccccgcatcaccgaggccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcgtggaagcagatccagaaggtcgagacgtgggccctccggcaccccgggttcaccgtgatcgccctgttcctggcccacgcgatcggcaccagcatcacccagaaggggatcatcttcatcctcctgatgctggtgacgccctccatggccatgcgctgcgtcggcatcggcagccgggacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcgcaagctctgcatcgaggcgaagatctccaacaccacgaccgacagccggtgcccgacccagggcgaggccaccctggtggaggagcaggacgccaacttcgtctgccgccggacgttcgtggaccgcggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccggaccggcctcgacttcaacgagatggtcctgctgaccatgaaggagaagtcctggctcgtgcacaagcagtggttcctggacctgcccctcccctggaccagcggggccagcacgtcccaggagacctggaaccgccaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccggctcaagatggacaagctgaccctgaagggcatgagctacgtcatgtgcacggggtccttcaagctcgagaaggaggtggccgagacccagcacggcaccatcctggtgcagatcaagtacgagggcaccgacgcgccctgcaagatccccttcagcacgcaggacgagaagggggtcacccagaacggccgcctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccgccggatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgcgagctcaagtgcgggagcggcatcttcgtcaccaacgaggtgcacacctggaccgagcagtacaagttccaggccgacagcccgaagcggctgtccgcggccatcggcaaggcctgggaggagggggtgtgcggcatccgcagcgccacccggctggagaacatcatgtggaagcagatctccaacgagctcaaccacatcctgctggagaacgacatgaagttcacggtcgtggtgggggacgtcgccggcatcctcgcgcaggggaagaagatgatccgcccccagcccatggagtacaagtacagctggaagtcctggggcaaggccaagatcatcggcgccgacgtgcagaacgccaccttcatcatcgacgggcccaacaccccggagtgccccgacgaccagcgggcgtggaacatctgggaggtggaggactacggcttcgggatcttcaccacgaacatctggctgaagctgcgcgacagctacacccaggtctgcgaccaccggctcatgtccgccgccatcaaggacagcaaggccgtgcacgccgacatgggctactggatcgagtccgagaagaacgagacctggaagctggcgcgcgccagcttcatcgaggtgaagacctgcatctggcccaagtcccacacgctgtggagcaacggcgtcctcgagtccgagatgatcatccccaagatctacgggggcccgatcagccagcacaactaccggcccgggtacttcacccagaccgccggcccctggcacctggggaagctggagctcgacttcgacctgtgcgagggcaccacggtggtggtcgacgagcactgcggcaaccgcgggccgtccctgcggaccaccaccgtgacgggcaagatcatccacgagtggtgctgccgcagctgcaccctgccgcccctccggttccgcggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcaccctggccgtgttcttcctgctcatcatggggcagctgacgtggaacgacctgatccggctctgcatcatggtgggcgcgaacgccagcgacaagatggggatgggcaccacctacctggccctgatggccaccttcaagatgcgcccgatgttcgccgtcggcctcctgttccgccggctgacgtcccgcgaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtgctgagcatcgtctccctcttccccctgtgcctgagcacgacctcccagaagaccacctggctccccgtgctgctgggcagcctcgggtgcaagccgctgacgatgttcctgatcgccgagaacaagatctggggccggaagtcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgcgacgacaccctgaccatcctcctgaaggccaccctgctcgccgtctccggcgtgtacccgctgagcatccccgccacgctgttcgtgtggtacttctggcagaagaagaagcagcggtccggggtcctctgggacacccccagcccgcccgaggtggagcgcgccgtgctggacgacggcatctaccggatcatgcagcgcggcctgctggggcggtcccaggtcggcgtgggggtgttccaggagaacgtcttccacaccatgtggcacgtgacccgcggcgcggtgctcatgtaccaggggaagcggctggagcccagctgggcctccgtcaagaaggacctgatcagctacggcggcgggtggcgcctccagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgggaggggaagatcgtgggcctgtacggcaacggggtggtcaccaccagcggcacctacgtgagcgccatcgcccaggccaaggcgtcccaggaggggccgctccccgagatcgaggacgaggtgttccgcaagcggaacctgacgatcatggacctgcaccccggcagcgggaagacccgccggtacctcccggccatcgtccgcgaggccatcaagcggaagctgcgcaccctgatcctcgcccccacccgggtggtggcctccgagatggcggaggccctgaagggcatgcccatccgctaccagacgaccgccgtcaagagcgagcacaccggcaaggagatcgtggacctgatgtgccacgccaccttcacgatgcgcctcctgtcccccgtgcgggtcccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagaccttcgacacggagtaccagaagaccaagaacaacgactgggactacgtggtgaccaccgacatcagcgagatgggcgcgaacttccgggccgaccgcgtcatcgacccgcggcgctgcctgaagcccgtgatcctgaaggacgggcccgagcgggtgatcctcgccggccccatgccggtcacggtggcctccgccgcgcagcgccgggggcgcatcggccggaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccggctgcgcggcgaggcccgcaagaccttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtgtccggggacctgatcctcgagatcggcaagctgccgcagcacctgacccagcgggcccagaacgccctcgacaacctggtcatgctgcacaacagcgagcagggcgggcgcgcgtaccggcacgccctcgaggagctgcccgacaccatcgagacgctgatgctcctggccctgatcgccgtgctcaccggcggggtgaccctgttcttcctgtccggccgcgggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccggcagcgcacgccccaggacaaccagctcgcctacgtggtgatcgggctgctgttcatgatcctcacggtcgccgcgaacgagatgggcctgctggagaccaccaagaaggacctcgggatcggccacgtggccgtggagaaccaccaccacgcctccatgctggacgtcgacctgcaccccgccagcgcctggaccctctacgcggtggccacgaccatcatcaccccgatgatgcggcacaccatcgagaacacgaccgccaacatctccctgaccgccatcgccaaccaggcggccatcctgatggggctcgacaagggctggcccatcagcaagatggacatcggcgtgcccctgctggccctcgggtgctactcccaggtcaaccccctgaccctgacggccgcggtgctcatgctggtggcccactacgccatcatcggcccggggctgcaggccaaggccacccgcgaggcgcagaagcggaccgccgccggcatcatgaagaaccccaccgtcgacgggatcgtggccatcgacctcgaccccgtggtctacgacgccaagttcgagaagcagctgggccagatcatgctgctcatcctgtgcacgagccagatcctgctcatgcgcaccacctgggcgctgtgcgagtccatcaccctggccacgggccccctcaccaccctgtgggaggggagcccgggcaagttctggaacaccacgatcgccgtgtccatggccaacatcttccgcgggagctacctggccggcgcgggcctcgccttcagcctgatgaagtccctcgggggcgggcggcgcgggaccggggcccagggcgagaccctcggcgagaagtggaagcggcagctgaaccagctgagcaagtccgagttcaacacctacaagcgcagcgggatcatggaggtggaccggtccgaggccaaggagggcctcaagcgcggggagacgaccaagcacgcggtcagccggggcaccgccaagctgcgctggttcgtggagcggaacctggtgaagcccgaggggaaggtcatcgacctgggctgcggccgcgggggctggtcctactactgcgccgggctcaagaaggtgaccgaggtgaagggctacacgaagggcgggcccggccacgaggagcccatcccgatggccacctacgggtggaacctggtcaagctgcacagcggcaaggacgtgttcttcatcccgcccgagaagtgcgacaccctcctgtgcgacatcggggagtccagccccaacccgaccatcgaggagggccggacgctgcgcgtgctcaagatggtcgagccctggctgcgggggaaccagttctgcatcaagatcctgaacccctacatgccctccgtggtggagaccctcgagcagatgcagcgcaagcacggcggcatgctggtccggaacccgctgagccgcaactccacccacgagatgtactgggtgagctgcgggaccggcaacatcgtgtccgccgtcaacatgaccagccggatgctcctgaaccgcttcacgatggcgcaccggaagcccacctacgagcgcgacgtggacctgggggccggcacccgccacgtggccgtcgagcccgaggtggccaacctcgacatcatcggccagcggatcgagaacatcaagcacgagcacaagtccacctggcactacgacgaggacaacccctacaagacgtgggcctaccacgggagctacgaggtgaagccgtccggcagcgcgagctccatggtcaacggggtggtcaagctgctgaccaagccctgggacgtgatccccatggtgacccagaccgccatgacggacaccacccccttcggccagcagcgcgtcttcaaggagaaggtggacacccggacgccgaaggccaagcgcgggaccgcccagatcatggaggtgaccgcccggtggctctggggcttcctgagccgcaacaagaagccccggatctgcacccgcgaggagttcacgcggaaggtccgctccaacgcggccatcggcgccgtgttcgtggacgagaaccagtggaacagcgccaaggaggcggtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtcgagggcgaggggctccacaagctgggctacatcctgcgcgacatctccaagatccccgggggcaacatgtacgccgacgacaccgccggctgggacacccggatcacggaggacgacctccagaacgaggccaagatcaccgacatcatggagccggagcacgccctgctggccaagagcatcttcaagctcacctaccagaacaaggtggtgcgcgtccagcggcccgccaagaacgggaccgtgatggacgtgatctcccgccgcgaccagcggggcagcgggcaggtcggcacgtacggcctgaacaccttcaccaacatggaggcccagctgatccgccagatggagtccgaggggatcttcagcccctccgagctcgagacccccaacctggccgagcgggtgctggactggctcgagaagtacggcgtggagcgcctgaagcggatggccatcagcggggacgactgcgtcgtgaagccgatcgacgaccgcttcgcgacggccctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtggtgccgtgccggaaccaggacgagctggtcggccgcgcccgggtgagccagggggccggctggtccctccgcgagaccgcgtgcctgggcaagagctacgcccagatgtggcagctgatgtacttccaccggcgcgacctccggctggccgccaacgcgatctgctccgccgtgcccgtcgactgggtgcccaccagccgcacgacctggtccatccacgcccaccaccagtggatgaccaccgaggacatgctgagcgtgtggaaccgggtctggatcgaggagaacccctggatggaggacaagacgcacatctccagctgggaggacgtgccgtacctcggcaagcgcgaggaccagtggtgcgggtccctgatcggcctgaccgcccgggccacctgggcgaccaacatccaggtggccatcaaccaggtccgccgcctcatcggcaacgagaactacctggactacatgaccagcatgaagcggttcaagaacgagtccgaccccgagggggccctgtggtga

SEQ ID NO: 8200 - RNA, 9879 nt, synthetic construct
  misc_feature 1..9879: note = derived and/or modified CDS sequence (opt1) from DENV-1__FJ687432__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccaccggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcgtggaagcagatccagaaggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgggacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcgcaagctctgcatcgaggcgaagatctccaacaccacgaccgacagccggtgcccgacccagggcgaggccaccctggtggaggagcaggacgccaacttcgtctgccgccggacgttcgtggaccgcggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccggaccggcctcgacttcaacgagatggtcctgctgaccatgaaggagaagtcctggctcgtgcacaagcagtggttcctggacctgcccctcccctggaccagcggggccagcacgtcccaggagacctggaaccgccaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccggctcaagatggacaagctgaccctgaagggcatgagctacgtcatgtgcacggggtccttcaagctcgagaaggaggtggccgagacccagcacggcaccatcctggtgcagatcaagtacgagggcaccgacgcgccctgcaagatccccttcagcacgcaggacgagaagggggtcacccagaacggccgcctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccgccggatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgcgagctcaagtgcgggagcggcatcttcgtcaccaacgaggtgcacacctggaccgagcagtacaagttccaggccgacagcccgaagcggctgtccgcggccatcggcaaggcctgggaggagggggtgtgcggcatccgcagcgccacccggctggagaacatcatgtggaagcagatctccaacgagctcaaccacatcctgctggagaacgacatgaagttcacggtcgtggtgggggacgtcgccggcatcctcgcgcaggggaagaagatgatccgcccccagcccatggagtacaagtacagctggaagtcctggggcaaggccaagatcatcggcgccgacgtgcagaacgccaccttcatcatcgacgggcccaacaccccggagtgccccgacgaccagcgggcgtggaacatctgggaggtggaggactacggcttcgggatcttcaccacgaacatctggctgaagctgcgcgacagctacacccaggtctgcgaccaccggctcatgtccgccgccatcaaggacagcaaggccgtgcacgccgacatgggctactggatcgagtccgagaagaacgagacctggaagctggcgcgcgccagcttcatcgaggtgaagacctgcatctggcccaagtcccacacgctgtggagcaacggcgtcctcgagtccgagatgatcatccccaagatctacgggggcccgatcagccagcacaactaccggcccgggtacttcacccagaccgccggcccctggcacctggggaagctggagctcgacttcgacctgtgcgagggcaccacggtggtggtcgacgagcactgcggcaaccgcgggccgtccctgcggaccaccaccgtgacgggcaagatcatccacgagtggtgctgccgcagctgcaccctgccgcccctccggttccgcggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcaccctggccgtgttcttcctgctcatcatggggcagctgacgtggaacgacctgatccggctctgcatcatggtgggcgcgaacgccagcgaccgcatggggatgggcaccacctacctggccctgatggccaccttcaagatgcgcccgatgttcgccgtcggcctcctgttccggcgcctgacgtcccgggaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtgctgagcatcgtctccctcttccccctgtgcctgagcacgacctcccagaagaccacctggctccccgtgctgctgggcagcctcgggtgcaagccgctgacgatgttcctgatcgccgagaacaagatctggggccgcaagtcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgggacgacaccctgaccatcctcctgaaggccaccctgctcgccgtctccggcgtgtacccgctgagcatccccgccacgctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacccggggcgcggtgctcatgtaccaggggaagcgcctggagcccagctgggcctccgtcaagaaggacctgatcagctacggcggcgggtggcggctccagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgcgaggggaagatcgtgggcctgtacggcaacggggtggtcaccaccagcggcacctacgtgagcgccatcgcccaggccaaggcgtcccaggaggggccgctccccgagatcgaggacgaggtgttccggaagcgcaacctgacgatcatggacctgcaccccggcagcgggaagacccggcgctacctcccggccatcgtccgggaggccatcaagcgcaagctgcggaccctgatcctcgcccccacccgcgtggtggcctccgagatggcggaggccctgaagggcatgcccatccgctaccagacgaccgccgtcaagagcgagcacaccggcaaggagatcgtggacctgatgtgccacgccaccttcacgatgcggctcctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctgaaggacgggcccgagcgcgtgatcctcgccggccccatgccggtcacggtggcctccgccgcgcagcggcgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcgcggcgaggcccggaagaccttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggacgaaggagggggagcggaagaagctgcgcccccggtggctggacgcccgcacctactccgaccccctcgccctgcgggagttcaaggagttcgcggccggccgccggagcgtgtccggggacctgatcctcgagatcggcaagctgccgcagcacctgacccagcgcgcccagaacgccctcgacaacctggtcatgctgcacaacagcgagcagggcgggcgggcgtaccgccacgccctcgaggagctgcccgacaccatcgagacgctgatgctcctggccctgatcgccgtgctcaccggcggggtgaccctgttcttcctgtccggccgggggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccgccagcggacgccccaggacaaccagctcgcctacgtggtgatcgggctgctgttcatgatcctcacggtcgccgcgaacgagatgggcctgctggagaccaccaagaaggacctcgggatcggccacgtggccgtggagaaccaccaccacgcctccatgctggacgtcgacctgcaccccgccagcgcctggaccctctacgcggtggccacgaccatcatcaccccgatgatgcgccacaccatcgagaacacgaccgccaacatctccctgaccgccatcgccaaccaggcggccatcctgatggggctcgacaagggctggcccatcagcaagatggacatcggcgtgcccctgctggccctcgggtgctactcccaggtcaaccccctgaccctgacggccgcggtgctcatgctggtggcccactacgccatcatcggcccggggctgcaggccaaggccacccgggaggcgcagaagcgcaccgccgccggcatcatgaagaaccccaccgtcgacgggatcgtggccatcgacctcgaccccgtggtctacgacgccaagttcgagaagcagctgggccagatcatgctgctcatcctgtgcacgagccagatcctgctcatgcgcaccacctgggcgctgtgcgagtccatcaccctggccacgggccccctcaccaccctgtgggaggggagcccgggcaagttctggaacaccacgatcgccgtgtccatggccaacatcttccgggggagctacctggccggcgcgggcctcgccttcagcctgatgaagtccctcgggggcgggcgccgggggaccggggcccagggcgagaccctcggcgagaagtggaagcgccagctgaaccagctgagcaagtccgagttcaacacctacaagcggagcgggatcatggaggtggaccgctccgaggccaaggagggcctcaagcgcggggagacgaccaagcacgcggtcagccgcggcaccgccaagctgcggtggttcgtggagcgcaacctggtgaagcccgaggggaaggtcatcgacctgggctgcggccgcggcgggtggtcctactactgcgccgggctcaagaaggtgaccgaggtgaaggggtacacgaagggcggccccggccacgaggagcccatcccgatggccacctacgggtggaacctggtcaagctgcacagcggcaaggacgtgttcttcatcccgcccgagaagtgcgacaccctcctgtgcgacatcggggagtccagccccaacccgaccatcgaggagggccgcacgctgcgggtgctcaagatggtcgagccctggctgcgcgggaaccagttctgcatcaagatcctgaacccctacatgccctccgtggtggagaccctcgagcagatgcagcggaagcacggcggcatgctggtccgcaacccgctgagccggaactccacccacgagatgtactgggtgagctgcgggaccggcaacatcgtgtccgccgtcaacatgaccagccgcatgctcctgaaccggttcacgatggcgcaccgcaagcccacctacgagcgcgacgtggacctgggggccggcacccggcacgtggccgtcgagcccgaggtggccaacctcgacatcatcggccagcgcatcgagaacatcaagcacgagcacaagtccacctggcactacgacgaggacaacccctacaagacgtgggcctaccacgggagctacgaggtgaagccgtccggcagcgcgagctccatggtcaacggggtggtcaagctgctgaccaagccctgggacgtgatccccatggtgacccagaccgccatgacggacaccacccccttcggccagcagcgggtcttcaaggagaaggtggacacccgcacgccgaaggccaagcgggggaccgcccagatcatggaggtgaccgcccgctggctctggggcttcctgagccggaacaagaagccccgcatctgcacccgggaggagttcacgcgcaaggtccggtccaacgcggccatcggcgccgtgttcgtggacgagaaccagtggaacagcgccaaggaggcggtcgaggacgagcgcttctgggacctggtgcaccgggagcgcgagctccacaagcaggggaagtgcgcgacctgcgtgtacaacatgatgggcaagcgggagaagaagctgggggagttcggcaaggccaaggggtcccgcgccatctggtacatgtggctgggcgcccggttcctcgagttcgaggcgctgggcttcatgaacgaggaccactggttcagccgcgagaactccctgagcggggtcgagggcgaggggctccacaagctgggctacatcctgcgggacatctccaagatccccgggggcaacatgtacgccgacgacaccgccggctgggacacccgcatcacggaggacgacctccagaacgaggccaagatcaccgacatcatggagccggagcacgccctgctggccaagagcatcttcaagctcacctaccagaacaaggtggtgcgggtccagcgccccgccaagaacgggaccgtgatggacgtgatctcccgccgggaccagcgcggcagcgggcaggtcggcacgtacggcctgaacaccttcaccaacatggaggcccagctgatccggcagatggagtccgaggggatcttcagcccctccgagctcgagacccccaacctggccgagcgcgtgctggactggctcgagaagtacggcgtggagcggctgaagcgcatggccatcagcggggacgactgcgtcgtgaagccgatcgacgaccggttcgcgacggccctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtggtgccgtgccgcaaccaggacgagctggtcggccgggcccgcgtgagccagggggccggctggtccctccgggagaccgcgtgcctgggcaagagctacgcccagatgtggcagctgatgtacttccaccgccgggacctccgcctggccgccaacgcgatctgctccgccgtgcccgtcgactgggtgcccaccagccggacgacctggtccatccacgcccaccaccagtggatgaccaccgaggacatgctgagcgtgtggaaccgcgtctggatcgaggagaacccctggatggaggacaagacgcacatctccagctgggaggacgtgccgtacctcggcaagcgggaggaccagtggtgcgggtccctgatcggcctgaccgcccgcgccacctgggcgaccaacatccaggtggccatcaaccaggtccgccggctcatcggcaacgagaactacctggactacatgaccagcatgaagcgcttcaagaacgagtccgaccccgagggggccctgtggtga

SEQ ID NO: 8201 - RNA, 9879 nt, synthetic construct
  misc_feature 1..9879: note = derived and/or modified CDS sequence (opt1) from DENV-1__JQ922547__SS-prME
  source 1..9879: mol_type = other RNA
agcgtgaccatgctgctcatgctgctgcccaccgccctcgccttccacctgaccacccggggcggggagccgcacatgatcgtgagcaagcaggagcggggcaagagcctcctgttcaagaccagcgcgggggtgaacatgtgcaccctgatcgccatggacctgggggagctctgcgaggacaccatgacctacaagtgcccccggatcaccgaggccgagcccgacgacgtggactgctggtgcaacgccaccgacacgtgggtgacctacgggacctgcagccagaccggggagcaccggcgcgacaagcggtccgtggccctggcgccccacgtggggctggggctcgagacgcgcgccgagacctggatgagcagcgagggcgcctggaagcagatccagaaggtcgagacctgggccctgcggcaccccgggttcaccgtgatcgcgctgttcctcgcccacgccatcggcacgagcatcacccagaaggggatcatcttcatcctgctgatgctcgtgaccccctccatggccatgcgctgcgtcggcatcggcaaccgggacttcgtggaggggctgagcggcgccccctgggtggacgtcgtgctggagcacgggtcctgcgtgaccacgatggcgaagaacaagcccaccctcgacatcgagctgctgaagaccgaggtcaccaacccggccgtgctccgcaagctgtgcatcgaggccaagatcagcaacacgaccaccgactcccggtgccccacccagggcgaggccacgctggtggaggagcaggacgccaactgcgtctgccgccggaccttcgtggaccgcggctgggggaacggctgcggcctgttcggcaaggggagcctgatcacgtgcgcgaagttcaagtgcgtgaccaagctggagggcaagatcgtccagtacgagaacctcaagtactccgtgatcgtgacggtccacaccggcgaccagcaccaggtggggaacgagaccaccacgcacggcaccaccgccaccatcacgccccaggcccccacgagcgagatccagctgaccgactacggggccctgaccctcgactgctccccgcggaccggcctggacttcaacgagatggtcctgctcacgatgaaggagaagtcctggctggtgcacaagcagtggttcctggacctccccctgccctggacctccggggccagcaccagccaggagacctggaaccgccaggacctgctcgtgacgttcaagaccgcgcacgccaagaagcaggaggtcgtggtgctgggctcccaggagggcgccatgcacaccgccctgaccggggccacggagatccagaccagcggcaccaccacgatcttcgcggggcacctcaagtgccggctgaagatggacaagctgaccctcaagggcatgtcctacgtcatgtgcaccgggagcttcaagctggagaaggaggtggccgagacccagcacggcacggtgctggtccaggtgaagtacgagggcaccgacgccccctgcaagatcccgttctccacccaggacgagaagggggccacccagaacggccgcctgatcacggcgaaccccatcgtgaccgacaaggagaagcccgtcaacatcgaggccgagcccccgttcggggagagctacatcgtggtgggcgccggcgagaaggccctcaagctgtcctggttcaagaaggggagctccatcggcaagatgctggaggccaccgcgcgcggggcccgccggatggccatcctcggcgacaccgcctgggacttcgggagcatcggcggcgtcttcacgtccatggggaagctggtgcaccaggtgttcggcaccgcctacggggtcctgttcagcggcgtgtcctggaccatgaagatcgggatcggcatcctcctgacctggctgggcctcaacagccgcaacacgtccctgagcatgatgtgcatcgcggtggggatggtcaccctgtacctcggcgtgatggtgcaggccgactccgggtgcgtcatcaactggaagggccgcgagctgctgtgcgggaccggcatcttcgtgaccaacgaggtgcacacgtggaccgacccctacaagttccaggccgaccccagcaaccggctctcccccatcatcggcaaggcctgcgtcatccgcgtgtgcgggatccggagcgccacccgcctggagaacatcatgtggaagcagatcagcaacgagctgaaccacatcctcctggagaacgacatgaagttcaccgtggtcgtgggcgacgtgtccgggatcctggcgcagggcgagaagatgatccggccgcagcccatggagcacaagtacagctggaagtcctgggggaaggccaagatcatcggcgccgacgtccagaacaccacgttcatcatcgacggccccaacacccccgagtgcccggacaaccagcgcgcctggaacatctgggaggtggaggactacgggttcggcatcttcaccaccaacatctggctcaagctgcgggacagctacacccaggtgtgcgaccaccgcctgatgtccgcggccatcaaggacagcaaggccgtccacgccgacatggggtactggatcgagtccgagaagaacgagacgtggaagctcgcccgggcgagcttcatcgaggtgaagacctgcacctggcccaagtcccacacgctgtggagcaacggcgtgctggagtccgagatgatcatccccaagatctacggcgggccgatcagccagcacaactaccgccccggctacttcacccagaccgccgggccctggcacctcggcaagctggagctggacttcgacttctgcgaggggaccacggtcgtggtggacgagcactgcggcaaccggggcccctccctccgcaccaccaccgtcacggggaagatcatccacgagtggtgctgccggagctgcaccctgccgcccctgcgcttcaagggcgaggacgggtgctggtacggcatggagatccggcccgtgaaggacaaggaggagaacctcgtgaagtccatggtcagcgccgggtccggcgaggtggacagcttcagcctgggcctgctctgcatctccatcatgatcgaggaggtgatgcgcagccggtggtccaagaagatgctgatggtcgggaccctggccgtgttcctcctgctgatcatgggccagctcacctggagcgacctgatccgcctgtgcatcatggtgggggccaacgcgtccgaccggatgggcatggggacgacctacctcgccctgatggccaccttcaagatgcgccccatgttcgccgtcggcctcctcttcccgaagctgaccagccgcgaggtgctgctcctgacgatcggcctgtccctcgtcgccagcgtggagctgccctccagcctggaggagctcggggacggcctggcgaaggggatcatgatgctgaagctcctgaccgacttccagtcccaccagctgtgggccaccctcctgagcctgaccttcatcaagacgaccttctccctccactacgcctggaagaccatggccatggtgctgagcatcgtctccctgttccccctctgcctgagcaccacgtcccagaagaccacctggctgcccgtgctcctgggcagcctgggctgcaagccgctccccatgttcctgatcaccgagaacaagatctgggggcggaagtcctggcccctgaacgagggcatcatggcggtggggatcgtcagcatcctcctgagctccctgctcaagaacgacgtgcccctggccggcccgctgatcgccgggggcatgctcgtggcctgctacgtcatcagcggctccagcgccgacctgtccctggagaaggcggccgaggtgagctgggaggaggaggccgagcactccggggccagccacaacatcctcgtggaggtccaggacgacggcacgcgcaagatcaaggacgaggagcgggacgacaccctgaccatcctgctcaaggccaccctgctggcggtgtccggggtgtaccccatgagcatccccgccaccctcttcgtctggtacttctggcagaagaagaaccagcgctccggcgtggggctgatcacgcccagcccgcccgaggtggagcgggccgtcctggacgacggcatctaccgcatcctgcagcggggcctcctggggcgctcccaggtgggcgtgggggtcttccaggagggcgtgttccacaccatgtggcacgtgacccgcggggccgtcctgatgtaccagggcaagcgcctcgagcccagctgggcctccgtgaagaaggacctgatcagctacggcgggggctggcggttccaggggtcctggaacaccggcgaggaggtgcaggtcatcgcggtggagcccgggcgcaacccgaagaacgtgcagacggcccccggcaccttcaagacccccgagggcgaggtcggggccatcccgctggacttcaagcccggcaccagcgggtcccccatcgtgaaccgggagggcaagatcgtgggcctctacgggaacggcgtcgtgacgaccagcgggacctacgtgagcgccatcgcccgcgcgaaggcctcccaggagggccccctgccggagatcgaggacgaggtcttccggaagcgcaacctgaccatcatggacctccaccccgggagcggcaagacgcggcgctacctgcccgccatcgtgcgggaggccatcaagcgcaagctgcggaccctcatcctggcgcccacccgcgtggtcgcctccgagatggccgaggccctgaagggcgtgccgatccgctaccagaccacggccgtcaagagcgagcacaccgggaaggagatcgtcgacctcatgtgccacgcgaccttcaccatgcggctgctgtcccccgtgcgcgtgcccaactacaacatgatcatcatggacgaggcccacttcacggaccccgccagcatcgccgcccggggctacatctccacccgcgtcgggatgggcgaggcggccgccatcttcatgaccgccaccccgacggggagcgtggaggccttcccccagtccaacgcgatcatccaggacgaggagcgggacatccccgagcgcagctggaactccggctacgactggatcaccgacttccccggcaagaccgtgtggttcgtcccgagcatcaagtccgggaacgacatcgccaactgcctcaagaagaacggcaagcgggtgatccagctgagccgcaagaccttcgacacggagtaccagaagaccaagaacaacgactgggactacgtggtcaccaccgacatctccgagatgggggccaacttccgggccgaccgcgtgatcgacccccggcgctgcctgaagcccgtcatcctcaaggacggccccgagcgggtgatcctggcggggccgatgcccgtgacggtcgccagcgccgcccagcgccggggccgcatcggccggaaccagaacaaggagggggaccagtacatctacatgggccagccctccaacaacgacgaggaccacgcccactggaccgaggcgaagatgctgctcgacaacatcaacacccccgaggggatcatcccggccctgttcgagcccgagcgcgagaagtccgccgccatcgacggcgagtaccggctgcgcggggaggcccgcaagaccttcgtggagctcatgcggcgcggcgacctgcccgtgtggctgtcctacaaggtcgcgagcgagggcttccagtacagcgaccggcgctggtgcttcgacggggagcggaacaaccaggtgctcgaggagaacaaggacgtggagatctggacgaaggagggcgagcgcaagaagctgcggacctgctggctggacgcccgcacctactccgaccccctcgccctgcgggagttcaaggagttcgccgccgggcgccggagcgtctccggcgacctgatcctcgagatcggcaagctgccgcagcacctgacccagaaggcgcagaaggccctcgacaacctggtgatgctgcacaacagcgagcagggcgggaaggcctaccgccacgccatggaggagctccccgacacgatcgagaccctgatgctgctcgcgctgatcgccgtgctgaccgggggcgtcaccctcttcttcctgtccgggcggggcctgggcaagaccagcatcgggctcctgtgcgtgatggcctccagcgtgctgctctggatggcctccgtcgagccccactggatcgccgcgagcatcatcctggagttcttcctgatggtgctcctgatcccggagcccgaccgccagcggacgccccaggacaaccagctggcctacgtggtcatcggcctcctgttcatgatcctgaccgtggccgccaacgagatggggctcctggagaccaccaagaaggacctgggcatcgggcacgtggccgcggagaaccaccaccacgccacgatgctcgacgtcgacctgcgccccgcctccgcctggaccctgtacgccgtggcgaccaccatcatcacgccgatgatgcggcacaccatcgagaacaccaccgccaacatcagcctcacggccatcgccaaccaggccgcgatcctgatgggcctggacaagggctggcccatctccaagatggacatcggggtgcccctcctggccctgggctgctacagccaggtcaaccccctcaccctgaccgccgccgtgctgatgctcgtggcgcactacgccatcatcgggccgggcctgcaggccaaggccacccgcgaggcccagaagcggacggcggccgggatcatgaagaaccccaccgtcgacggcatcgtggccatcgacctggaccccgtggtctacgacgccaagttcgagaagcagctcggccagatcatgctgctgatcctctgcacctcccagatcctgctgatgcgcaccacgtgggccctctgcgagagcatcaccctggcgaccgggcccctgaccacgctctgggagggctccccggggcggttctggaacaccaccatcgccgtgagcatggccaacatcttccgcggctcctacctggccggcgccgggctggcgttcagcctcatgaagtccctgggcgggggccgccgggggaccggcgcccagggcgagacgctgggggagaagtggaagcgccagctcaaccagctgtccaagagcgagttcaacacctacaagcggtccggcatcatggaggtggaccgcagcgaggccaaggaggggctgaagcggggcgagaccaccaagcacgccgtctcccgcgggacggcgaagctccggtggttcgtggagcgcaacctggtgaagcccgagggcaaggtcatcgacctgggctgcgggcggggcgggtggagctactactgcgccggcctgaagaaggtgaccgaggtgaaggggtacaccaagggcggccccgggcacgaggagcccatcccgatggccacctacggctggaacctcgtcaagctgcactccgggaaggacgtgttcttcatcccgcccgagaagtgcgacacgctgctctgcgacatcggcgagagctcccccaacccgaccatcgaggaggggcgcaccctgcgggtgctgaagatggtcgagccctggctccgcggcaaccagttctgcatcaagatcctgaacccctacatgcccagcgtggtggagaccctggagcagatgcagcggaagcacggcgggatgctcgtccgcaacccgctgtcccggaacagcacccacgagatgtactgggtgtcctgcggcacggggaacatcgtgagcgccgtcaacatgacctcccgcatgctgctcaaccggttcaccatggcccaccgcaagcccacctacgagcgggacgtggacctgggcgcgggcacgcgccacgtggccgtcgagcccgaggtggccaacctggacatcatcgggcagcgcatcgagaacatcaagaacgagcacaagagcacctggcactacgacgaggacaacccctacaagacctgggcctaccacggctcctacgaggtcaagccgagcgggtccgccagcagcatggtgaacggcgtggtccggctcctgaccaagccctgggacgtgatccccatggtgacgcagatcgcgatgaccgacaccaccccgttcgggcagcagcgcgtcttcaaggagaaggtggacacgcggacccccaaggccaagcgcggcaccgcccagatcatggaggtgaccgcccggtggctgtggggcttcctctcccgcaacaagaagccccggatctgcacgcgcgaggagttcacccggaaggtccgcagcaacgccgcgatcggggccgtgttcgtggacgagaaccagtggaactccgccaaggaggccgtcgaggacgagcggttctgggacctggtgcaccgcgagcgggagctgcacaagcagggcaagtgcgcgacctgcgtgtacaacaagatggggaagcgcgagaagaagctcggcgagttcgggaaggccaagggcagccgggccatctggtacatgtggctgggcgcccgcttcctggagttcgaggccctcgggttcatgaacgaggaccactggttctcccgggagaacagcctgtccggcgtcgagggggagggcctgcacaagctcgggtacatcctgcgcgacatcagccggatccccggcggcaacatgtacgcggacgacaccgccgggtgggacacgcgcatcaccgaggacgacctgcagaacgaggccaagatcaccgacatcatggagccggagcacgccctcctggccacctccatcttcaagctgacgtaccagaacaaggtggtgcgggtccagcgccccgcgaagaacggcaccgtgatggacgccatcagccgccgggaccagcgcgggtccggccaggtgggcacctacgggctcaacaccttcctgcacaaggaggcccagctgatccggcagatggagttcgagggcatcttcctccccagcgagctggagacgcccaacctggccgggcgcgtcctcgactggctggagcagtacggcgtggagcggctgaagcgcatggccatctccggggacgactgcgtggtcaagccgatcgacgaccggttcgcgaccgccctcaccgccctgaacgacatgggcaaggtgcgcaaggacatcccccagtgggagcccagcaagggctggggcgactggcagcaggtccccttctgctcccaccacttccaccagctgatcatgaaggacgtccgggagatcgtggtgccgtgccgcaaccaggacgagctcgtcggccgggcccgcgtgagccagggggccggctggtccctgcgggagaccgcgtgcctgggcaagagctacgcccagatgtggcagctcatgtacttccaccgccgggacctgcgcctggccgccaacgcgatctgcagcgccgtgcccgtcgactgggtgcccacgtcccggaccacctggagcatccacgcccaccaccagtggatgaccacggaggacatgctctccgtgtggaaccgcgtctggatcgaggagaacccctggatggaggacaagacccacgtgagctcctgggaggacgtgccgtacctgggcaagcgggaggaccagtggtgcggcagcctgatcgggctcaccgcccgcgccacctgggcgaccaacatccaggtcgccatcaaccaggtgcgccggctgatcggcaacgagaactacctggactacatgacgtccatgaagcgcttcaagaacgagagcgaccccgagggggccctctggtga

SEQ ID NO: 8202 - RNA, 9879 nt, synthetic construct
  misc_feature 1..9879: note = derived and/or modified CDS sequence (opt1) from DENV-1__EU482567__SS-prME
  source 1..9879: mol_type = other RNA
agcgtgaccatgctgctcatgctgctgcccaccgccctcgccttccacctgaccacccggggcggggagccgcacatgatcgtgagcaagcaggagcggggcaagagcctcctgttcaagaccagcgcggggatcaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgggacaagcggtccgtcgccctggcgccccacgtgggcctggggctcgagacgcggaccgagacctggatgagctccgagggcgcctggaagcagatccagaaggtggagacctgggccctgcggcaccccgggttcacggtcaccgccctgttcctcgcgcacgccatcggcaccagcatcacccagaaggggatcatcttcatcctgctgatcctcgtgacgccctccatggccatgcgctgcgtgggcatcggcaaccgggacttcgtcgaggggctgagcggcgccacctgggtggacgtggtcctggagcacgggtcctgcgtgaccaccatggccaaggacaagcccacgctcgacatcgagctgctgaagaccgaggtgaccaaccccgcggtcctccgcaagctgtgcatcgaggccaagatcagcaacaccacgaccgactcccggtgccccacccagggcgaggccaccctggtggaggagcaggacagcaacttcgtgtgccgccggacgttcgtcgaccgcggctgggggaacggctgcggcctcttcggcaaggggtccctgctgacctgcgccaagttcaagtgcgtgaccaagctcgagggcaagatcgtgcagtacgagaacctgaagtacagcgtcatcgtgaccgtgcacacgggcgaccagcaccaggtcgggaacgagaccaccgagcacggcaccatcgccaccatcacgccccaggcgcccacctccgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggaccagcggggccagcacctcccaggagacgtggaaccgccaggacctcctggtgaccttcaagaccgcccacgccaagaagcaggaggtggtcgtgctgggcagccaggagggcgcgatgcacaccgccctcacgggggccaccgagatccagacctccggcaccacgaccatcttcgccgggcacctgaagtgccggctgaagatggacaagctcaccctgaagggcatgagctacgtgatgtgcaccgggtccttcaagctggagaaggaggtcgccgagacgcagcacggcaccgtgctggtgcaggtcaagtacgagggcaccgacgcgccctgcaagatccccttcagcgcccaggacgagaagggggtgacccagaacggccgcctcatcacggccaacccgatcgtgaccgacaaggagaagcccgtcaacatcgagaccgagccgcccttcggggagtcctacatcgtggtgggcgccggcgagaaggcgctgaagctgagctggttcaagaaggggtccagcatcggcaagatgttcgaggccaccgcccgcggggcccgccggatggccatcctcggcgacacggcgtgggacttcgggtccatcggcggcgtcttcaccagcgccgggaagctggtgcaccaggtgttcggcgccgcctacggggtcctgttctccggcgtgagctggaccatgaagatcgggatcggcatcctcctgacctggctgggcctcaactcccgcagcacgtccctgagcatgacctgcatcgccgtggggatggtcaccctgtacctcggcgtggtggtccaggcggactccgggtgcgtgatcaactggaagggccgcgagctgaagtgcgggagcggcatcttcgtgaccaacgaggtccacacgtggaccgagcagtacaagttccaggccgacagcccgaagcggctgtccgccgccatcggcaaggcctgggaggagggggtgtgcggcatccgcagcgcgacccggctcgagaacatcatgtggaagcagatctccaacgagctgaaccacatcctgctcgagaacgacatgaagttcaccgtggtcgtgggggacgccaacggcatcctggcccaggggaagaagatgatccgcccccagcccatggagcaccggtacagctggaagtcctggggcaaggccaagatcatcggcgcggacatccagaacgccaccttcatcatcgacgggcccgacacgccggagtgccccgacgaccagcgcgcctggaacatctgggaggtggaggactacggcttcgggatcttcaccaccaacatctggctgaagctccgggacagctacacccagatgtgcgaccaccgcctgatgtccgccgccatcaaggacagcaaggcggtccacgccgacatgggctactggatcgagtccgagaagaacgagacgtggaagctggcccgggccagcttcatcgaggtgaagacctgcatctggcccaagtcccacaccctctggagcaacggcgtgctggagtccgagatgatcatccccaagatctacgggggcccgatcagccagcacaactaccgccccgggtacttcacccagacggccggcccctggcacctggggaagctcgagctggacttcgacctgtgcgagggcaccaccgtcgtggtggacgagcactgcggcaaccgggggccgtccctccgcaccacgaccgtcaccggcaagatcatccacgagtggtgctgccggagctgcaccctgccgcccctgcgcttccgcggggaggacggctgctggtacgggatggagatccgccccgtgaaggagaaggaggagaacctcgtgcggtccatggtcagcgcgggcagcggcgaggtggactccttcagcctggggatcctgtgcgtgtccatcatgatcgaggaggtcatgcgcagccggtggtcccgcaagatgctcatgacgggcaccctggccgtgttcctgctcctgatcatggggcagctgacctggaaggacctcatccgcctgtgcatcatggtgggcgccaacgccagcgaccggatggggatgggcaccacgtacctggccctcatggcgaccttcaagatgcgcccgatgttcgccgtcgggctgctgttccggcgcctcacctcccgggaggtgctgctgctcaccatcgggctgagcctggtggcctccgtcgagctccccaacagcctggaggagctgggcgacgggctcgccatgggcatcatgatgctgaagctgctcacggagttccagccccaccagctgtggaccaccctgctctccctgaccttcatcaacacgaccctgagcctcgactacgcgtggcgcaccatggccatggtgctgtccatcatcagcctgttccccctctgcctgtccaccacgagccagaagaccacctggctgccggtcctcctgggctccttcgggtgcaagcccctgaccatgttcctcatcacggagaacaagatctggggccgcaagagctggcccctgaacgaggggatcatggccatcggcatcgtgtccatcctgctcagcagcctgctgaagaacgacgtgcccctcgccgggccgctgatcgccggcggcatgctgatcgcgtgctacgtcatctccgggagctccgccgacctcagcctggagaaggccgccgaggtgtcctgggaggaggaggccgagcacagcggcacctcccacaacatcctggtggaggtccaggacgacgggaccatgaagatcaaggacgaggagcgcgacgacaccctcaccatcctgctgaaggcgacgctcctggccgtgagcggcgtgtaccccatgtccatccccgccaccctgttcgtctggtacttctggcagaagaagaagcagcggagcggggtgctctgggacaccccctccccgcccgaggtggagcgcgccgtcctggacgacggcatctaccggatcctgcagcgcggcctgctcgggcggagccaggtgggcgtgggggtcttccaggacggcgtgttccacaccatgtggcacgtgacgcgcggggccgtcctgatgtaccagggcaagcggctggagccctcctgggcgagcgtgaagaaggacctcatctcctacggcgggggctggcgcttccaggggagctggaacaccggcgaggaggtgcaggtcatcgccgtggagcccgggaagaacccgaagaacgtgcagaccacccccggcacgttcaagacccccgagggcgaggtcggggccatcgccctggacttcaagcccggcacctccgggagcccgatcgtgaaccgggagggcaagatcgtgggcctgtacgggaacggcgtcgtgaccacgtccgggacctacgtgagcgccatcgcgcaggccaagaccagccaggagggccccctccccgagatcgaggacgaggtcttcaagaagcgcaacctgaccatcatggacctgcacccggggtccggcaagacgcggcgctacctccccgccatcgtgcgggaggccatcaagcgcaagctgcgcaccctgatcctcgcgcccacccgggtggtcgccagcgagatggccgaggccctgaagggcatgcccatccgctaccagaccacggccgtgaagtccgagcacaccgggcgggagatcgtggacctgatgtgccacgcgaccttcaccatgcgcctcctgagcccggtccgggtgcccaactacaacatgatcatcatggacgaggcccacttcacggaccccgcctccatcgccgcccgcggctacatcagcacccgggtggggatgggcgaggcggccgccatcttcatgaccgccacgccgcccgggtccgtcgaggccttcccccagagcaacgcggtgatccaggacgaggagcgcgacatccccgagcggtcctggaacagcggctacgactggatcacggacttccccggcaagaccgtgtggttcgtcccctccatcaagagcgggaacgacatcgccaactgcctgcgcaagaacggcaagcgggtgatccagctctcccgcaagaccttcgacaccgagtaccagaagacgaagaacaacgactgggactacgtggtcaccaccgacatcagcgagatgggggccaacttccgggccgaccgcgtgatcgacccccggcgctgcctgaagcccgtgatcctgaaggacggccccgagcgggtcatcctcgcggggccgatgcccgtgaccgtggcctccgccgcccagcgccggggccgcatcggccgcaaccagaacaaggagggggaccagtacgtctacatgggccagcccctgaacaacgacgaggaccacgcccactggacggaggcgaagatgctgctcgacaacatcaacacccccgaggggatcatcccggccctgttcgagcccgagcgggagaagtccgccgccatcgacggcgagtaccgcctgcgcggggaggcccgcaagaccttcgtggagctcatgcggcgcggcgacctgcccgtctggctgtcctacaaggtggcgagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcccggacgtacagcgacccgctcgccctgcgcgagttcaaggagttcgccgccgggcggcgcagcgtgtccggcgacctgatcctcgagatcggcaagctgccccagcacctgaccctccgggcgcagaacgccctggacaacctggtgatgctccacaacagcgagcagggcgggaaggcctaccgccacgccatggaggagctgcccgacaccatcgagaccctgatgctcctggcgctgatcgccgtcctcaccgggggcgtgacgctgttcttcctgtccgggaagggcctcggcaagaccagcatcgggctgctgtgcgtgatggcctccagcgccctcctgtggatggccaacgtcgagccccactggatcgcggcctccatcatcctggagttcttcctcatggtgctgctgatcccggagcccgaccggcagcgcacgccccaggacaaccagctcgcctacgtggtcatcggcctgctgttcatgatcctcaccgtggccgccaacgagatggggctgctggagacgaccaagaaggacctcggcatcgggcacgtggcggccgagaaccaccaccacgccaccatgctggacgtcgacctgcggccggccagcgcctggaccctctacgcggtggccacgaccgtgatcacccccatgatgcgccacaccatcgagaacacgaccgccaacatctccctgaccgccatcgccaaccaggcggccatcctgatgggcctcgacaagggctggcccatcagcaagatggacatcggggtccccctgctggccctcggctgctactcccaggtgaacccgctgaccctgacggccgcggtgctcatgctggtcgcccactacgccatcatcgggcccggcctgcaggccaaggccacccgcgaggcgcagaagcggaccgccgccgggatcatgaagaaccccaccgtggacggcatcgtggccatcgacctcgaccccgtcgtgtacgacgccaagttcgagaagcagctgggccagatcatgctgctcatcctgtgcacgagccagatcctgctcatgcgcaccacctgggcgctgtgcgagtccatcaccctggccacggggccgctcaccaccctgtgggagggcagccccgggaagttctggaacaccacgatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgtccaagagcgagttcaacacctacaagcggagcggcatcatggaggtcgaccgctccgaggcccgggaggggctcaagcgcggcgagacgaccaagcacgcggtgagccgggggaccgccaagctgcgctggttcgtggagcggaacctggtcaagcccgagggcaaggtgatcgacctgggctgcgggcgcggcgggtggtcctactactgcgccggcctcaagaaggtgaccgaggtcaaggggtacacgaagggcggccccgggcacgaggagccgatccccatggccacctacggctggaacctggtgaagctgtacagcgggaaggacgtgttcttcatcccgcccgagaagtgcgacaccctcctgtgcgacatcggcgagtccagcccgaaccccaccatcgaggaggggcggaccctgcgcgtcctcaagatggtggagccctggctgcggggcaaccagttctgcatcaagatcctgaacccctacatgccgtccgtggtcgagacgctcgagcagatgcagcgcaagcacggcgggatgctggtgcggaaccccctgagccgcaactccacccacgagatgtactgggtgagctgcggcaccgggaacatcgtctccgccgtgaacatgaccagccgcatgctcctgaaccggttcacgatggcgcaccgcaagcccacctacgagcgggacgtggacctgggcgccggcacccgccacgtcgccgtggagcccgaggtggccaacctcgacatcatcgggcagcggatcgagaacatcaagaacgagcacaagtccacctggcactacgacgaggacaacccgtacaagacgtgggcctaccacggcagctacgaggtcaagccctccgggagcgcgtccagcatggtgaacggcgtggtccgcctgctgaccaagccctgggacgtgatccccatggtcacccagatcgccatgaccgacacgaccccgttcgggcagcagcgggtgttcaaggagaaggtggacacccgcacgccccgggccaagcgcggcacggcccagatcatggaggtcaccgccaagtggctctggggcttcctgtcccggaacaagaagccccgcatctgcacccgggaggagttcacccgcaaggtgcggagcaacgcggccatcggggccgtgttcgtcgacgagaaccagtggaacagcgccaaggaggcggtggaggacgagcgcttctggaacctggtgcaccgggagcgcgagctccacaagcagggcaagtgcgccacgtgcgtctacaacatgatggggaagcgggagaagaagctgggcgagttcgggaaggccaagggctcccgcgccatctggtacatgtggctgggcgcccggttcctcgagttcgaggcgctggggttcatgaacgaggaccactggttcagccgcgagaactccttcagcggcgtggagggggagggcctgcacaagctcgggtacatcctgcgcgacatctccaagatcccgggcggcaacatgtacgccgacgacaccgccgggtgggacacccggatcaccgaggacgacctgcagaacgaggccaagatcacggacatcatggagcccgagcacgccctcctggcgaccagcatcttcaagctgacctaccagaacaaggtggtccgcgtgcagcggcccgccaagaacggcaccgtgatggacgtcatctcccgccgggaccagcgcgggagcggccaggtgggcacgtacgggctcaacaccttcaccaacatggaggtgcagctgatccggcagatggagtccgagggcatcttcctgcccagcgagctcgagaccccgaacctggccgagcgcgtcctggactggctcgagaagcacgggacggagcggctgaagcgcatggccatctccggcgacgactgcgtggtgaagcccgtcgacgagcggttcgccaccgcgctgatcgccctcaacgacatggggaaggtgcgcaaggacatcccccagtgggagcccagcaagggctggaacgactggcagcaggtcccgttctgctcccaccacttccaccagctgatcatgaaggacggccgggagatcgtcgtgccctgccgcaaccaggacgagctggtggggcgggcccgcgtcagccagggcgccgggtggtccctccgggagaccgcctgcctgggcaagagctacgcgcagatgtggcagctgatgtacttccaccgccgggacctccgcctggccgccaacgccatctgctccgcggtgcccgtggactgggtccccaccagccgcacgacctggagcatccacgcccaccaccagtggatgaccaccgaggacatgctgtccgtgtggaaccgggtgtggatcgaggagaacccgtggatggaggacaagacccacgtcagctcctgggaggaggtgccctacctcgggaagcgcgaggaccagtggtgcggcagcctgatcggcctgacggcccgggccacctgggccaccaacatccaggtggcgatcaaccaggtccgccggctcatcgggaacgagaactacctggactacatgacctccatgaagcgcttcaagaacgagagcgaccccgagggcgccctgtggtga

SEQ ID NO: 8203 - RNA, 9879 nt, synthetic construct
  misc_feature 1..9879: note = derived and/or modified CDS sequence (opt1) from DENV-1__FJ390378__SS-prME
  source 1..9879: mol_type = other RNA
agcgtgaccatgctgctcatgctgctgcccaccgccctcgccttccacctgaccacccggggcggggagccccacatgatcgtgtccaagcaggagcggggcaagagcctcctgttcaagacctccgccgggatcaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtcgccctggcgccccacgtgggcctggggctcgagacccgcaccgagacctggatgagctccgagggcgcctggaagcagatccagaaggtggagacctgggccctgcggcaccccgggttcacggtcaccgccctgttcctcgcgcacgccatcggcaccagcatcacccagaaggggatcatcttcatcctgctgatgctcgtgacgccctccatggccatgcgctgcgtgggcatcggcaaccgggacttcgtcgaggggctgagcggcgccacctgggtggacgtggtcctggagcacgggtcctgcgtgaccaccatggccaaggacaagcccacgctcgacatcgagctgctgaagaccgaggtgaccaaccccgcggtcctccgcaagctgtgcatcgaggccaagatcagcaacaccacgaccgactcccggtgcccgacccagggcgaggccaccctggtggaggagcaggacagcaacttcgtgtgccgccggacgttcgtcgaccgcggctgggggaacggctgcggcctcttcggcaaggggtccctgctgacctgcgccaagttcaagtgcgtgaccaagctcgagggcaagatcgtgcagtacgagaacctgaagtacagcgtcatcgtgaccgtgcacacgggcgaccagcaccaggtcgggaacgagaccaccgagcacggcaccatcgccaccatcacgccccaggcgcccacctccgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggaccagcggggccagcacctcccaggagacgtggaaccgccaggacctcctggtgaccttcaagaccgcccacgccaagaagcaggaggtggtcgtgctgggcagccaggagggcgcgatgcacaccgccctcacgggggccaccgagatccagacctccggcaccacgaccatcttcgccgggcacctgaagtgccggctgaagatggacaagctcaccctgaagggcatgagctacgtgatgtgcaccgggtccttcaagctggagaaggaggtcgccgagacgcagcacggcaccgtgctggtgcaggtcaagtacgagggcaccgacgcgccctgcaagatccccttcagcgcccaggacgagaagggggtgacccagaacggccgcctcatcacggccaacccgatcgtgaccgacaaggagaagcccgtcaacatcgagaccgagccgcccttcggggagtcctacatcgtggtgggcgccggcgagaaggcgctgaagctgagctggttcaagaaggggtccagcatcggcaagatgttcgaggccaccgcccgcggggcccgccggatggccatcctcggcgacacggcgtgggacttcgggtccatcggcggcgtcttcaccagcgtggggaagctggtgcaccaggtcttcggcgccgcctacggggtgctgttctccggcgtgagctggaccatgaagatcgggatcggcatcctcctgacctggctgggcctcaactcccgcagcacgtccctgagcatgacctgcatcgccgtcgggatggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggcggacagcccgaagcggctgtccgccgccatcggcaaggcctgggaggagggggtgtgcggcatccgcagcgccacccggctcgagaacatcatgtggaagcagatctccaacgagctgaaccacatcctgctcgagaacgacatgaagttcaccgtggtcgtgggggacgcgaacggcatcctggcccaggggaagaagatgatccgcccccagcccatggagcaccggtacagctggaagtcctggggcaaggccaagatcatcggcgccgacatccagaacagcaccttcatcatcgacgggcccgacacgccggagtgccccgacgaccagcgcgcgtggaacatctgggaggtggaggactacggcttcgggatcttcaccaccaacatctggctgaagctccgggactcctacacccagatgtgcgaccaccgcctgatgagcgccgccatcaaggactccaaggccgtccacgccgacatgggctactggatcgagagcgagaagaacgagacgtggaagctggcgcgggcctccttcatcgaggtgaagacctgcatctggcccaagagccacaccctctggtccaacggcgtgctggagagcgagatgatcatccccaagatctacgggggcccgatctcccagcacaactaccgccccgggtacttcacccagacggccggcccctggcacctggggaagctcgagctggacttcgacctgtgcgagggcaccaccgtcgtggtggacgagcactgcggcaaccgggggccgagcctccgcaccacgaccgtcaccggcaagatcatccacgagtggtgctgccggtcctgcaccctgccgcccctgcgcttccgcggggaggacggctgctggtacgggatggagatccgccccgtgaaggagaaggaggagaacctcgtgcggagcatggtcagcgccggctccggcgaggtggacagcttctccctggggatcctgtgcgtgagcatcatgatcgaggaggtcatgcgctcccggtggagccgcaagatgctcatgacgggcaccctggccgtgttcctgctcctgatcatggggcagctgacctggaacgacctcatccgcctgtgcatcatggtgggcgcgaacgcctccgaccggatggggatgggcaccacgtacctggccctcatggccaccttcaagatgcgcccgatgttcgccgtcgggctgctgttccggcgcctcaccagccgggaggtgctgctgctcaccatcgggctgtccctggtggcgagcgtcgagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggcgcaccatggccatggtgctgagcatcgtctccctgttccccctctgcctgagcaccacgtcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtgagcatcctgctcagctccctgctgaagaacgacgtccccctcgccgggccgctgatcgccggcggcatgctgatcgcctgctacgtgatcagcgggtccagcgccgacctctccctggagaaggcggccgaggtgagctgggaggaggaggccgagcactccggcaccagccacaacatcctggtcgaggtgcaggacgacgggaccatgaagatcaaggacgaggagcgcgacgacaccctcaccatcctgctgaaggccacgctcctggccgtgtccggcgtctaccccatgagcatccccgcgaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacaccatgtggcacgtcacgcgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagaccacccccggcacgttcaagacccccgagggcgaggtgggggcgatcgccctggacttcaagcccggcaccagcgggtccccgatcgtgaaccgggagggcaagatcgtcggcctgtacgggaacggcgtggtgaccacgagcgggacctacgtcagcgccatcgcccaggccaagacctcccaggagggccccctccccgagatcgaggaggaggtgttcaagaagcgcaacctgaccatcatggacctgcacccggggagcggcaagacgcggcgctacctccccgcgatcgtgcgggaggccatcaagcgcaagctgcgcaccctgatcctcgcccccacccgggtcgtggcctccgagatggcggaggccctgaagggcatgcccatccgctaccagaccacggccgtcaagagcgagcacaccgggcgggagatcgtcgacctgatgtgccacgccaccttcaccatgcgcctcctgtccccggtgcgggtgcccaactacaacatgatcatcatggacgaggcccacttcacggaccccgcgagcatcgccgcccgcggctacatctccacccgggtcgggatgggcgaggccgccgcgatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgccaactgcctgcgcaagaacggcaagcgggtgatccagctcagccgcaagaccttcgacaccgagtaccagaagacgcggaacaacgactgggactacgtcgtgaccaccgacatctccgagatgggggcgaacttccgcgccgaccgggtgatcgacccccgccggtgcctgaagcccgtcatcctgaaggacggccccgagcgcgtgatcctcgccgggccgatgcccgtgaccgtcgccagcgcggcccagcggcgcggccgcatcggccggaaccagaacaaggagggggaccagtacgtgtacatgggccagcccctgaacaacgacgaggaccacgcccactggacggaggccaagatgctgctcgacaacatcaacacccccgaggggatcatcccggccctgttcgagcccgagcgcgagaagtccgcggccatcgacggcgagtaccggctgcgcggggaggcccggaagaccttcgtcgagctcatgcgccggggcgacctgcccgtgtggctgagctacaaggtggcctccgagggcttccagtacagcgaccgccggtggtgcttcgacggggagcgcaacaaccaggtcctcgaggagaacatggacgtggagatctggaccaaggagggcgagcggaagaagctgcgcccccggtggctggacgcccgcacgtacagcgacccgctcgcgctgcgggagttcaaggagttcgccgccgggcgccggtccgtgagcggcgacctgatcctcgagatcggcaagctgccccagcacctgaccctccgcgcccagaacgccctggacaacctggtcatgctccacaactccgagcagggcgggaaggcgtaccggcacgccatggaggagctgcccgacaccatcgagaccctgatgctcctggccctgatcgccgtgctcaccgggggcgtgacgctgttcttcctgagcgggaagggcctcggcaagacctccatcgggctgctgtgcgtcatggcgagctccgccctcctgtggatggccaacgtggagccccactggatcgccgccagcatcatcctggagttcttcctcatggtgctgctgatcccggagcccgaccgccagcggacgccccaggacaaccagctcgcgtacgtcgtgatcggcctgctgttcatgatcctcaccgtggccgccaacgagatggggctgctggagacgaccaagaaggacctcggcatcgggtacgtcgccgccgagaaccagcaccacgcgaccatgctggacgtggacctgcgcccggcctccgcctggaccctctacgccgtggccacgaccgtcatcacccccatgatgcgccacaccatcgagaacacgaccgcgaacatcagcctgaccgccatcgccaaccaggccgccatcctgatgggcctcgacaagggctggcccatctccaagatggacatcggggtgcccctgctggcgctcggctgctacagccaggtgaacccgctgaccctgacggccgccgtcctcatgctggtggcccactacgcgatcatcgggcccggcctgcaggccaaggccacccgggaggcccagaagcgcaccgccgcggggatcatgaagaaccccaccgtggacggcatcgtcgccatcgacctcgaccccgtggtgtacgacgccaagttcgagaagcagctgggccagatcatgctgctcatcctgtgcacgtcccagatcctgctcatgcggaccacctgggccctgtgcgagagcatcaccctggccacggggccgctcaccaccctgtgggagggctcccccgggaagttctggaacaccacgatcgcggtcagcatggccaacatcttccgcggctcctacctggccggcgccgggctcgccttcagcctgatgaagtccctgggcgggggccggcgcgggaccggcgcgcagggcgagaccctcggggagaagtggaagcggcagctgaaccagctgagcaagagcgagttcaacacctacaagcgctccggcatcatggaggtggaccggagcgaggccaaggaggggctcaagcgcggcgagacgaccaagcacgccgtgtcccgggggaccgccaagctgcgctggttcgtcgagcggaacctggtgaagcccgagggcaaggtgatcgacctgggctgcgggcgcggcgggtggagctactactgcgcgggcctcaagaaggtcaccgaggtgaaggggtacacgaagggcggccccgggcacgaggagccgatccccatggccacctacggctggaacctggtgaagctgtactccgggaaggacgtcttcttcacgccgcccgagaagtgcgacaccctcctgtgcgacatcggcgagagctccccgaaccccaccatcgaggaggggcggacgctgcgcgtgctcaagatggtggagccctggctgcggggcaaccagttctgcatcaagatcctgaacccctacatgccgagcgtcgtggagaccctcgagcagatgcagcgcaagcacggcgggatgctggtgcggaaccccctgtcccgcaacagcacccacgagatgtactgggtctcctgcggcaccgggaacatcgtgagcgccgtgaacatgacgtcccgcatgctcctgaaccggttcaccatgacccaccgcaagcccacctacgagcgggacgtcgacctgggcgccggcacgcgccacgtggccgtggagcccgaggtcgcgaacctcgacatcatcgggcagcggatcgagaacatcaagaacgagcacaagagcacctggcactacgacgaggacaacccgtacaagacctgggcctaccacggctcctacgaggtgaagcccagcgggtccgccagctccatggtgaacggcgtcgtgcgcctgctgaccaagccctgggacgtcatccccatggtgacgcagatcgccatgaccgacaccaccccgttcgggcagcagcgggtgttcaaggagaaggtcgacacgcgcacgccccgggccaagcgcggcaccgcgcagatcatggaggtgaccgccaagtggctctggggcttcctgagccggaacaagaagccccgcatctgcacgcgggaggagttcacccgcaaggtgcggagcaacgccgccatcggggccgtcttcgtggacgagaaccagtggaactccgcgaaggaggccgtggaggacgagcgcttctgggacctggtccaccgggagcgcgagctccacaagcagggcaagtgcgcgacctgcgtgtacaacatgatggggaagcgggagaagaagctgggcgagttcgggaaggccaagggcagccgcgcgatctggtacatgtggctgggcgcccggttcctcgagttcgaggccctggggttcatgaacgaggaccactggttctcccgcgagaacagcttctccggcgtggagggggagggcctgcacaagctcgggtacatcctgcgcgacatcagcaagatcccgggcggcaacatgtacgccgacgacaccgccgggtgggacacgcggatcaccgaggacgacctgcagaacgaggcgaagatcaccgacatcatggagcccgagcacgccctcctggccacctccatcttcaagctgacgtaccagaacaaggtcgtgcgcgtgcagcggcccgccaagaacggcaccgtcatggacgtgatcagccgccgggaccagcgcgggtccggccaggtgggcacctacgggctcaacaccttcacgaacatggaggtccagctgatccggcagatggagagcgagggcatcttcctgccctccgagctcgagaccccgaacctggccgagcgcgtgctgaactggctcgagaagcacgggaccgagcggctgaagcgcatggcgatcagcggcgacgactgcgtggtcaagcccgtggacgaccggttcgccaccgccctgatcgccctcaacgacatggggaaggtgcgcaaggacatcccccagtgggagccctccaagggctggaacgactggcagcaggtcccgttctgcagccaccacttccaccagctgatcatgaaggacggccgggagatcgtggtgccctgccgcaaccaggacgagctggtcgggcgggcccgcgtgtcccagggcgcggggtggagcctccgggagacggcctgcctgggcaagtcctacgcccagatgtggcagctgatgtacttccaccgccgggacctccgcctggccgccaacgcgatctgcagcgccgtgcccgtcgactgggtgcccaccagccgcaccacctggtccatccacgcccaccaccagtggatgaccacggaggacatgctgagcgtgtggaaccgggtctggatcgaggagaacccgtggatggaggacaagacccacgtgtccagctgggaggaggtgccctacctcgggaagcgcgaggaccagtggtgcggctccctgatcggcctgaccgcccgggcgacctgggccacgaacatccaggtcgccatcaaccaggtgcgccggctcatcgggaacgagaactacctggactacatgaccagcatgaagcgcttcaagaacgagtccgaccccgagggcgccctgtggtga

SEQ ID NO: 8204 - RNA, 9879 nt, synthetic construct
  misc_feature 1..9879: note = derived and/or modified CDS sequence (opt1) from DENV-1__FJ205872__SS-prME
  source 1..9879: mol_type = other RNA
agcgtgaccatgctgctcatgctgctgcccaccgccctcgccttccacctgaccacccggggcggggagccccacatgatcgtgtccaagcaggagcggggcaagagcctcctcttcaagacctccgccgggatcaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtcgccctggcgccccacgtgggcctggggctcgagacgcgcaccgagacctggatgagctccgagggcgcctggaagcagatccagaaggtggagacctgggccctgcggcaccccgggttcacggtgaccgccttcttcctggcgcacgccatcggcaccagcatcacccagaaggggatcatcttcatcctcctgatgctggtgacgccctccatggccatgcgctgcgtgggcatcggcaaccgggacttcgtcgaggggctcagcggcgccacctgggtggacgtggtcctggagcacgggtcctgcgtgaccaccatggccaaggacaagcccacgctggacatcgagctcctgaagaccgaggtgaccaaccccgcggtcctgcgcaagctctgcatcgaggccaagatcagcaacaccacgaccgactcccggtgcccgacccagggcgaggccaccctggtggaggagcaggacagcaacttcgtgtgccgccggacgttcgtcgaccgcggctgggggaacggctgcgggctgttcggcaaggggtccctcctgacctgcgccaagttcaagtgcgtgaccaagctggagggcaagatcgtgcagtacgagaacctcaagtacagcgtcatcgtgaccgtgcacacgggcgaccagcaccaggtcgggaacgagaccaccgagcacggcaccatcgccaccatcacgccccaggcgcccacctccgagatccagctgaccgactacggggccctgaccctcgactgcagcccccggacgggcctggacttcaacgagatggtgctgctcaccatgaaggagaagtcctggctggtccacaagcagtggttcctggacctcccgctgccctggaccagcggggccagcacctcccaggagacgtggaaccgccaggacctgctcgtgaccttcaagaccgcccacgccaagaagcaggaggtggtcgtgctgggcagccaggagggcgcgatgcacaccgccctgacgggggccaccgagatccagacctccggcaccacgaccatcttcgccgggcacctcaagtgccggctgaagatggacaagctgaccctcaagggcatgagctacgtgatgtgcaccgggtccttcaagctggagaaggaggtcgccgagacgcagcacggcaccgtgctggtgcaggtcaagtacgagggcaccgacgcgccctgcaagatccccttcagcgcccaggacgagaagggggtgacccagaacggccgcctgatcacggccaacccgatcgtgaccgacaaggagaagcccgtcaacatcgagaccgagccgcccttcggggagtcctacatcgtggtgggcgccggcgagaaggcgctcaagctgagctggttcaagaaggggtccagcatcggcaagatgttcgaggccaccgcccgcggggcccgccggatggccatcctgggcgacacggcgtgggacttcgggtccatcggcggcgtcttcaccagcgtggggaagctcgtgcaccaggtcttcggcgccgcctacggggtgctgttctccggcgtgagctggaccatgaagatcgggatcggcatcctgctcacctggctgggcctgaactcccgcagcacgtccctcagcatgacctgcatcgccgtcgggatggtgaccctgtacctgggcgtgatggtccaggccgactccgggtgcgtgatcaactggaagggccgcgagctcaagtgcgggagcggcatcttcgtgaccaacgaggtccacacgtggaccgagcagtacaagttccaggcggacagcccgaagcggctgtccgccgccatcggcaaggcctgggaggagggggtgtgcggcatccgcagcgccacccggctggagaacatcatgtggaagcagatctccaacgagctcaaccacatcctgctggagaacgacatgaagttcaccgtggtcgtgggggacgcgaacggcatcctcgcccaggggaagaagatgatccgcccccagcccatggagcaccggtacagctggaagtcctggggcaaggccaagatcatcggcgccgacatccagaacagcaccttcatcatcgacgggcccgacacgccggagtgccccgacgaccagcgcgcgtggaacatctgggaggtggaggactacggcttcgggatcttcaccaccaacatctggctgaagctgcgggactcctacacccagatgtgcgaccaccgcctcatgagcgccgccatcaaggactccaaggccgtccacgccgacatgggctactggatcgagagcgagaagaacgagacgtggaagctggcgcgggcctccttcatcgaggtgaagacctgcatctggcccaagagccacaccctgtggtccaacggcgtgctcgagagcgagatgatcatccccaagatctacgggggcccgatctcccagcacaactaccgccccgggtacttcacccagacggccggcccctggcacctggggaagctggagctcgacttcgacctgtgcgagggcaccaccgtcgtggtggacgagcactgcggcaaccgggggccgagcctgcgcaccacgaccgtcaccggcaagatcatccacgagtggtgctgccggtcctgcaccctgccgcccctgcgcttccgcggggaggacggctgctggtacgggatggagatccgccccgtgaaggagaaggaggagaacctggtgcggagcatggtcagcgccggctccggcgaggtggacagcttctccctcgggatcctgtgcgtgagcatcatgatcgaggaggtcatgcgctcccggtggagccgcaagatgctgatgacgggcaccctcgccgtgttcctgctgctcatcatggggcagctgacctggaacgacctgatccgcctctgcatcatggtgggcgcgaacgcctccgaccggatggggatgggcaccacgtacctggccctgatggccaccttcaagatgcgcccgatgttcgccgtcggcctcctgttccggcgcctgaccagccgggaggtgctcctgctgaccatcgggctctccctggtggcgagcgtcgagctgcccaactccctcgaggagctgggcgacgggctggccatgggcatcatgatgctcaagctgctgacggagttccagccccaccagctctggaccaccctgctgagcctcaccttcatcaagacgaccctgtccctggactacgcctggcgcaccatggccatggtgctcagcatcgtctccctgttccccctgtgcctcagcaccacgtcccagaagaccacctggctgccggtgctgctcggcagcttcgggtgcaagcccctgaccatgttcctgatcacggagaacaagatctggggccggaagtcctggcccctcaacgaggggatcatggcgatcggcatcgtgagcatcctgctgagctccctcctgaagaacgacgtccccctggccgggccgctcatcgccggcggcatgctgatcgcctgctacgtgatcagcgggtccagcgccgacctgtccctcgagaaggcggccgaggtgagctgggaggaggaggccgagcactccggcaccagccacaacatcctggtcgaggtgcaggacgacgggaccatgaagatcaaggacgaggagcgcgacgacaccctgaccatcctcctgaaggccacgctgctcgccgtgtccggcgtctaccccatgagcatccccgcgaccctgttcgtgtggtacttctggcagaagaagaagcagcggtccggggtgctgtgggacacccccagcccgcccgaggtcgagcgcgccgtgctcgacgacggcatctaccggatcctgcagcgcggcctgctggggcggtcccaggtgggcgtcggggtgttccaggacggcgtgttccacaccatgtggcacgtcacgcgcggggccgtgctcatgtaccagggcaagcggctggagcccagctgggcctccgtgaagaaggacctgatcagctacggcgggggctggcgcttccaggggtcctggaacaccggcgaggaggtccaggtgatcgccgtggagcccgggaagaacccgaagaacgtccagaccacccccggcacgttcaagacccccgagggcgaggtgggggcgatcgccctcgacttcaagcccggcaccagcgggtccccgatcgtgaaccgggagggcaagatcgtcggcctgtacgggaacggcgtggtgaccacgagcgggacctacgtcagcgccatcgcccaggccaagacctcccaggagggccccctgcccgagatcgaggaggaggtgttcaagaagcgcaacctcaccatcatggacctgcacccggggagcggcaagacgcggcgctacctgcccgcgatcgtgcgggaggccatcaagcgcaagctccgcaccctgatcctggcccccacccgggtcgtggcctccgagatggcggaggccctcaagggcatgcccatccgctaccagaccacggccgtcaagagcgagcacaccgggcgggagatcgtcgacctgatgtgccacgccaccttcaccatgcgcctgctctccccggtgcgggtgcccaactacaacatgatcatcatggacgaggcccacttcacggaccccgcgagcatcgccgcccgcggctacatctccacccgggtcgggatgggcgaggccgccgcgatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgccaactgcctgcgcaagaacggcaagcgggtgatccagctgagccgcaagaccttcgacaccgagtaccagaagacgcggaacaacgactgggactacgtcgtgaccaccgacatctccgagatgggggcgaacttccgcgccgaccgggtgatcgacccccgccggtgcctcaagcccgtcatcctgaaggacggccccgagcgcgtgatcctggccgggccgatgcccgtgaccgtcgccagcgcggcccagcggcgcggccgcatcggccggaaccagaacaaggagggggaccagtacgtgtacatgggccagcccctcaacaacgacgaggaccacgcccactggacggaggccaagatgctgctggacaacatcaacacccccgaggggatcatcccggccctcttcgagcccgagcgcgagaagtccgcggccatcgacggcgagtaccggctgcgcggggaggcccggaagaccttcgtcgagctgatgcgccggggcgacctccccgtgtggctgagctacaaggtggcctccgagggcttccagtacagcgaccgccggtggtgcttcgacggggagcgcaacaaccaggtcctggaggagaacatggacgtggagatctggaccaaggagggcgagcggaagaagctccgcccccggtggctggacgcccgcacgtacagcgacccgctggcgctccgggagttcaaggagttcgccgccgggcgccggtccgtgagcggcgacctgatcctggagatcggcaagctcccccagcacctgaccctgcgcgcccagaacgccctcgacaacctggtcatgctgcacaactccgagcagggcgggaaggcgtaccggcacgccatggaggagctccccgacaccatcgagaccctgatgctgctcgccctgatcgccgcgctgaccgggggcgtgaccctcttcttcctgagcgggaagggcctgggcaagacctccatcgggctcctgtgcgtgatggccagctccgccctgctctggatggccaacgtcgagccccactggatcgccgcgagcatcatcctggagttcttcctgatggtgctcctgatcccggagcccgaccgccagcggacgccccaggacaaccagctggcctacgtggtcatcggcctcctgttcatgatcctgaccgtggccgccaacgagatggggctcctggagacgaccaagaaggacctgggcatcgggtacgtggccgcggagaaccagcaccacgccaccatgctcgacgtcgacctgcgcccggcctccgcctggaccctgtacgccgtggcgacgaccgtgatcacccccatgatgcgccacaccatcgagaacacgaccgccaacatcagcctcaccgccatcgccaaccaggccgcgatcctgatgggcctggacaagggctggcccatctccaagatggacatcggggtccccctcctggccctgggctgctacagccaggtgaacccgctcaccctgacggccgccgtgctgatgctcgtcgcgcactacgccatcatcgggcccggcctgcaggccaaggccacccgggaggcccagaagcgcaccgcggccgggatcatgaagaaccccaccgtggacggcatcgtggccatcgacctggaccccgtcgtgtacgacgccaagttcgagaagcagctcggccagatcatgctgctgatcctctgcacgtcccagatcctgctgatgcggaccacctgggccctctgcgagagcatcaccctggcgacggggccgctgaccaccctctgggagggctcccccgggaagttctggaacaccacgatcgccgtgagcatggccaacatcttccgcggctcctacctggccggcgccgggctggcgttcagcctcatgaagtccctgggcgggggccggcgcgggaccggcgcccagggcgagaccctgggggagaagtggaagcggcagctcaaccagctgagcaagagcgagttcaacacctacaagcgctccggcatcatggaggtcgaccggagcgaggccaaggaggggctgaagcgcggcgagacgaccaagcacgccgtgtcccgggggaccgcgaagctccgctggttcgtggagcggaacctggtcaagcccgagggcaaggtgatcgacctgggctgcgggcgcggcgggtggagctactactgcgccggcctgaagaaggtgaccgaggtcaaggggtacacgaagggcggccccgggcacgaggagccgatccccatggccacctacggctggaacctcgtgaagctgtactccgggaaggacgtgttcttcacgccgcccgagaagtgcgacaccctgctctgcgacatcggcgagagctccccgaaccccaccatcgaggaggggcggacgctgcgcgtcctgaagatggtggagccctggctccggggcaaccagttctgcatcaagatcctgaacccctacatgccgagcgtggtcgagaccctggagcagatgcagcgcaagcacggcgggatgctcgtgcggaaccccctgtcccgcaacagcacccacgagatgtactgggtgtcctgcggcaccgggaacatcgtcagcgccgtgaacatgacgtcccgcatgctgctcaaccggttcaccatgacccaccgcaagcccacctacgagcgggacgtggacctgggcgccggcacgcgccacgtcgcggtggagcccgaggtggccaacctggacatcatcgggcagcggatcgagaacatcaagaacgagcacaagagcacctggcactacgacgaggacaacccgtacaagacctgggcctaccacggctcctacgaggtcaagcccagcgggtccgccagctccatggtgaacggcgtggtccgcctcctgaccaagccctgggacgtgatccccatggtcacgcagatcgccatgaccgacaccaccccgttcgggcagcagcgggtgttcaaggagaaggtggacacgcgcacgccccgggcgaagcgcggcaccgcccagatcatggaggtcaccgccaagtggctgtggggcttcctcagccggaacaagaagccccgcatctgcacgcgggaggagttcacccgcaaggtgcggagcaacgccgccatcggggcggtgttcgtcgacgagaaccagtggaactccgccaaggaggccgtggaggacgagcgcttctgggacctggtgcaccgggagcgcgagctgcacaagcagggcaagtgcgcgacctgcgtctacaacatgatggggaagcgggagaagaagctcggcgagttcgggaaggcgaagggcagccgcgccatctggtacatgtggctgggcgcccggttcctggagttcgaggccctcgggttcatgaacgaggaccactggttctcccgcgagaacagcttctccggcgtggagggggagggcctgcacaagctggggtacatcctccgcgacatcagcaagatcccgggcggcaacatgtacgccgacgacaccgcggggtgggacacgcggatcaccgaggacgacctgcagaacgaggccaagatcaccgacatcatggagcccgagcacgccctgctcgccacctccatcttcaagctgacgtaccagaacaaggtggtccgcgtgcagcggcccgccaagaacggcaccgtgatggacgtcatcagccgccgggaccagcgcgggtccggccaggtgggcacctacgggctgaacaccttcacgaacatggaggtgcagctcatccggcagatggagagcgagggcatcttcctgccctccgagctggagaccccgaacctcgcggagcgcgtcctgaactggctggagaagcacgggaccgagcggctcaagcgcatggccatcagcggcgacgactgcgtggtgaagcccgtcgacgaccggttcgccaccgccctgatcgccctgaacgacatggggaaggtgcgcaaggacatcccccagtgggagccctccaagggctggaacgactggcagcaggtcccgttctgcagccaccacttccaccagctcatcatgaaggacggccgggagatcgtcgtgccctgccgcaaccaggacgagctggtggggcgggcgcgcgtctcccagggcgccgggtggagcctgcgggagacggcctgcctcggcaagtcctacgcccagatgtggcagctgatgtacttccaccgccgggacctgcgcctcgccgcgaacgccatctgcagcgccgtgcccgtggactgggtccccaccagccgcaccacctggtccatccacgcccaccaccagtggatgaccacggaggacatgctgagcgtgtggaaccgggtgtggatcgaggagaacccgtggatggaggacaagacccacgtctccagctgggaggaggtgccctacctggggaagcgcgaggaccagtggtgcggctccctcatcggcctgaccgcgcgggccacctgggccacgaacatccaggtggccatcaaccaggtccgccggctgatcgggaacgagaactacctcgactacatgaccagcatgaagcgcttcaagaacgagtccgaccccgagggcgccctgtggtga

SEQ ID NO: 8205 - RNA, 9879 nt, synthetic construct
  misc_feature 1..9879: note = derived and/or modified CDS sequence (opt1) from DENV-1__FJ205873__SS-prME
  source 1..9879: mol_type = other RNA
agcgtgaccatgctgctcatgctgctgcccaccgccctcgccttccacctgaccacccggggcggggagccccacatgatcgtgtccaagcaggagcggggcaagagcctcctgttcaagacctccgccgggatcaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgggacaagcggtccgtcgccctggcgccccacgtgggcctggggctcgagacccgcaccgagacctggatgagctccgagggcgcctggaagcagatccagaaggtggagacctgggccctgcggcaccccgggttcacggtcaccgccctgttcctcgcgcacgccatcggcaccagcatcacccagaaggggatcatcttcatcctgctgatgctcgtgacgccctccatggccatgcgctgcgtgggcatcggcaaccgggacttcgtcgaggggctgagcggcgccacctgggtggacgtggtcctggagcacgggtcctgcgtgaccaccatggccaaggacaagcccacgctcgacatcgagctgctgaagaccgaggtgaccaaccccgcggtcctccgcaagctgtgcatcgaggccaagatcagcaacaccacgaccgactcccggtgcccgacccagggcgaggccaccctggtggaggagcaggacagcaacttcgtgtgccgccggacgttcgtcgaccgcggctgggggaacggctgcggcctcttcggcaaggggtccctgctgacctgcgccaagttcaagtgcgtgaccaagctcgagggcaagatcgtgcagtacgagaacctgaagtacagcgtcatcgtgaccgtgcacacgggcgaccagcaccaggtcgggaacgagaccaccgagcacggcaccatcgccaccatcacgccccaggcgcccacctccgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggaccagcggggccagcacctcccaggagacgtggaaccgccaggacctcctggtgaccttcaagaccgcccacgccaagaagcaggaggtggtcgtgctgggcagccaggagggcgcgatgcacaccgccctcacgggggccaccgagatccagacctccggcaccacgaccatcttcgccgggcacctgaagtgccggctgaagatggacaagctcaccctgaagggcatgagctacgtgatgtgcaccgggtccttcaagctggagaaggaggtcgccgagacgcagcacggcaccgtgctggtgcaggtcaagtacgagggcaccgacgcgccctgcaagatccccttcagcgcccaggacgagaagggggtgacccagaacggccgcctcatcacggccaacccgatcgtgaccgacaaggagaagcccgtcaacatcgagaccgagccgcccttcggggagtcctacatcgtggtgggcgccggcgagaaggcgctgaagctgagctggttcaagaaggggtccagcatcggcaagatgttcgaggccaccgcccgcggggcccgccggatggccatcctcggcgacacggcgtgggacttcgggtccatcggcggcgtcttcaccagcgtggggaagctggtgcaccaggtcttcggcgccgcctacggggtgctgttctccggcgtgagctggaccatgaagatcgggatcggcatcctcctgacctggctgggcctcaactcccgcagcacgtccctgagcatgacctgcatcgccgtcgggatggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggcggacagcccgaagcggctgtccgccgccatcggcaaggcctgggaggagggggtgtgcggcatccgcagcgccacccggctcgagaacatcatgtggaagcagatctccaacgagctgaaccacatcctgctcgagaacgacatgaagttcaccgtggtcgtgggggacgcgaacggcatcctggcccaggggaagaagatgatccgcccccagcccatggagcaccggtacagctggaagtcctggggcaaggccaagatcatcggcgccgacatccagaacagcaccttcatcatcgacgggcccgacacgccggagtgccccgacgaccagcgcgcgtggaacatctgggaggtggaggactacggcttcgggatcttcaccaccaacatctggctgaagctccgggactcctacacccagatgtgcgaccaccgcctgatgagcgccgccatcaaggactccaaggccgtccacgccgacatgggctactggatcgagagcgagaagaacgagacgtggaagctggcgcgggcctccttcatcgaggtgaagacctgcatctggcccaagagccacaccctctggtccaacggcgtgctggagagcgagatgatcatccccaagatctacgggggcccgatctcccagcacaactaccgccccgggtacttcacccagacggccggcccctggcacctggggaagctcgagctggacttcgacctgtgcgagggcaccaccgtcgtggtggacgagcactgcggcaaccgggggccgagcctccgcaccacgaccgtcaccggcaagatcatccacgagtggtgctgccggtcctgcaccctgccgcccctgcgcttccgcggggaggacggctgctggtacgggatggagatccgccccgtgaaggagaaggaggagaacctcgtgcggagcatggtcagcgccggctccggcgaggtggacagcttctccctggggatcctgtgcgtgagcatcatgatcgaggaggtcatgcgctcccggtggagccgcaagatgctcatgacgggcaccctggccgtgttcctgctcctgatcatggggcagctgacctggaacgacctcatccgcctgtgcatcatggtgggcgcgaacgcctccgaccggatggggatgggcaccacgtacctggccctcatggccaccttcaagatgcgcccgatgttcgccgtcgggctgctgttccggaagctcaccagccgcgaggtgctgctgctcaccatcgggctgtccctggtggcgagcgtcgagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggcggaccatggccatggtgctgagcatcgtctccctgttccccctctgcctgagcaccacgtcccagaagaccacctggctgccggtgctcctgggcagcttcgggtgcaagcccctgaccatgttcctcatcacggagaacaagatctggggccgcaagtcctggcccctgaacgaggggatcatggcgatcggcatcgtgagcatcctgctcagctccctgctgaagaacgacgtccccctcgccgggccgctgatcgccggcggcatgctgatcgcctgctacgtgatcagcgggtccagcgccgacctctccctggagaaggcggccgaggtgagctgggaggaggaggccgagcactccggcaccagccacaacatcctggtcgaggtgcaggacgacgggaccatgaagatcaaggacgaggagcgggacgacaccctcaccatcctgctgaaggccacgctcctggccgtgtccggcgtctaccccatgagcatccccgcgaccctgttcgtgtggtacttctggcagaagaagaagcagcgctccggggtgctctgggacacccccagcccgcccgaggtcgagcgggccgtgctggacgacggcatctaccgcatcctgcagcggggcctgctcgggcgctcccaggtgggcgtcggggtgttccaggacggcgtgttccacaccatgtggcacgtcacgcgcggggccgtgctgatgtaccagggcaagcgcctggagcccagctgggcctccgtgaagaaggacctcatcagctacggcgggggctggcggttccaggggtcctggaacaccggcgaggaggtccaggtgatcgccgtggagcccgggaagaacccgaagaacgtccagaccacccccggcacgttcaagacccccgagggcgaggtgggggcgatcgccctggacttcaagcccggcaccagcgggtccccgatcgtgaaccgcgagggcaaggtcgtgggcctgtacgggaacggcgtggtcaccacgagcgggacctacgtgagcgccatcgcccaggccaagacctcccaggagggccccctccccgagatcgaggaggaggtgttcaagaagcggaacctgaccatcatggacctgcacccggggagcggcaagacgcgccggtacctccccgcgatcgtccgcgaggccatcaagcggaagctgcgcaccctgatcctcgcccccacccgcgtggtggcctccgagatggcggaggccctgaagggcatgcccatccggtaccagaccacggccgtcaagagcgagcacaccgggcgcgagatcgtggacctgatgtgccacgccaccttcaccatgcggctcctgtccccggtgcgcgtccccaactacaacatgatcatcatggacgaggcccacttcacggaccccgcgagcatcgccgcccggggctacatctccacccgcgtggggatgggcgaggccgccgcgatcttcatgaccgccacgccgcccgggagcgtggaggccttcccccagtccaacgccgtcatccaggacgaggagcgggacatccccgagcgcagctggaactccggctacgactggatcacggacttccccggcaagaccgtgtggttcgtgcccagcatcaagtccgggaacgacatcgccaactgcctgcggaagaacggcaagcgcgtcatccagctcagccggaagaccttcgacaccgagtaccagaagacgcgcaacaacgactgggactacgtggtgaccaccgacatctccgagatgggggcgaacttccgggccgaccgcgtcatcgacccccggcgctgcctgaagcccgtgatcctgaaggacggccccgagcgggtgatcctcgccgggccgatgcccgtcaccgtggccagcgcggcccagcgccggggccgcatcggccgcaaccagaacaaggagggggaccagtacgtctacatgggccagcccctgaacaacgacgaggaccacgcccactggacggaggccaagatgctgctcgacaacatcaacacccccgaggggatcatcccggccctgttcgagcccgagcgggagaagtccgcggccatcgacggcgagtaccgcctgcgcggggaggcccgcaagaccttcgtggagctcatgcggcgcggcgacctgcccgtgtggctgagctacaaggtcgcctccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacgtacagcgacccgctcgcgctgcgcgagttcaaggagttcgccgccgggcggcgctccgtcagcggcgacctgatcctcgagatcggcaagctgccccagcacctgaccctccgggcccagaacgccctggacaacctggtgatgctccacaactccgagcagggcgggaaggcgtaccgccacgccatggaggagctgcccgacaccatcgagaccctgatgctcctggccctgatcgccgtgctcaccgggggcgtcacgctgttcttcctgagcgggaagggcctcggcaagacctccatcgggctgctgtgcgtgatggcgagctccgccctcctgtggatggccaacgtggagccccactggatcgccgccagcatcatcctggagttcttcctcatggtcctgctgatcccggagcccgaccggcagcgcacgccccaggacaaccagctcgcgtacgtggtgatcggcctgctgttcatgatcctcaccgtcgccgccaacgagatggggctgctggagacgaccaagaaggacctcggcatcgggcacgtggccgccgagaaccagcaccacgcgaccatgctggacgtggacctgcggccggcctccgcctggaccctctacgccgtcgccacgaccgtgatcacccccatgatgcgccacaccatcgagaacacgaccgcgaacatcagcctgaccgccatcgccaaccaggccgccatcctgatgggcctcgacaagggctggcccatctccaagatggacatcggggtgcccctgctggcgctcggctgctacagccaggtcaacccgctgaccctgacggccgccgtgctcatgctggtggcccactacgcgatcatcgggcccggcctgcaggccaaggccacccgcgaggcccagaagcggaccgccgcggggatcatgaagaaccccaccgtcgacggcatcgtggccatcgacctcgaccccgtggtctacgacgccaagttcgagaagcagctgggccagatcatgctgctcatcctgtgcacgtcccagatcctgctcatgcgcaccacctgggccctgtgcgagagcatcaccctggccacggggccgctcaccaccctgtgggagggctcccccgggaagttctggaacaccacgatcgcggtgagcatggccaacatcttccggggctcctacctggccggcgccgggctcgccttcagcctgatgaagtccctgggcgggggccgccgggggaccggcgcgcagggcgagaccctcggggagaagtggaagcgccagctgaaccagctgagcaagagcgagttcaacacctacaagcggtccggcatcatggaggtggaccgcagcgaggccaaggaggggctcaagcggggcgagacgaccaagcacgccgtctcccgcgggaccgccaagctgcggtggttcgtggagcgcaacctggtgaagcccgagggcaaggtcatcgacctgggctgcgggcggggcgggtggagctactactgcgcgggcctcaagaaggtgaccgaggtgaaggggtacacgaagggcggccccgggcacgaggagccgatccccatggccacctacggctggaacctggtcaagctgtactccgggaaggacgtgttcttcacgccgcccgagaagtgcgacaccctcctgtgcgacatcggcgagagctccccgaaccccaccatcgaggaggggcgcacgctgcgggtgctcaagatggtcgagccctggctgcgcggcaaccagttctgcatcaagatcctgaacccctacatgccgagcgtggtggagaccctcgagcagatgcagcggaagcacggcgggatgctggtccgcaaccccctgtcccggaacagcacccacgagatgtactgggtgtcctgcggcaccgggaacatcgtgagcgccgtcaacatgacgtcccgcatgctcctgaaccgcttcaccatgacccaccggaagcccacctacgagcgcgacgtggacctgggcgccggcacgcggcacgtggccgtcgagcccgaggtggcgaacctcgacatcatcgggcagcgcatcgagaacatcaagaacgagcacaagagcacctggcactacgacgaggacaacccgtacaagacctgggcctaccacggctcctacgaggtgaagcccagcgggtccgccagctccatggtcaacggcgtggtccggctgctgaccaagccctgggacgtgatccccatggtgacgcagatcgccatgaccgacaccaccccgttcgggcagcagcgcgtcttcaaggagaaggtggacacgcggacgccccgggccaagcggggcaccgcgcagatcatggaggtgaccgccaagtggctctggggcttcctgagccgcaacaagaagccccggatctgcacgcgcgaggagttcacccggaaggtccgcagcaacgccgccatcggggccgtgttcgtggacgagaaccagtggaactccgcgaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggcgatctggtacatgtggctgggcgcccgcttcctcgagttcgaggccctggggttcatgaacgaggaccactggttctcccgggagaacagcttctccggcgtcgagggggagggcctgcacaagctcgggtacatcctgcgcgacatcagcaagatcccgggcggcaacatgtacgccgacgacaccgccgggtgggacacgcgcatcaccgaggacgacctgcagaacgaggcgaagatcaccgacatcatggagcccgagcacgccctcctggccacctccatcttcaagctgacgtaccagaacaaggtggtgcgggtccagcgccccgccaagaacggcaccgtgatggacgtgatcagccggcgcgaccagcgggggtccggccaggtcggcacctacgggctcaacaccttcacgaacatggaggtgcagctgatccgccagatggagagcgagggcatcttcctgccctccgagctcgagaccccgaacctggccgagcgggtgctgaactggctcgagaagcacgggaccgagcgcctgaagcggatggcgatcagcggcgacgactgcgtcgtgaagcccgtggacgaccgcttcgccaccgccctgatcgccctcaacgacatggggaaggtccggaaggacatcccccagtgggagccctccaagggctggaacgactggcagcaggtcccgttctgcagccaccacttccaccagctgatcatgaaggacggccgcgagatcgtggtcccctgccggaaccaggacgagctggtggggcgcgcccgggtgtcccagggcgcggggtggagcctccgcgagacggcctgcctgggcaagtcctacgcccagatgtggcagctgatgtacttccaccggcgcgacctccggctggccgccaacgcgatctgcagcgccgtccccgtggactgggtgcccaccagccgcaccacctggtccatccacgcccaccaccagtggatgaccacggaggacatgctgagcgtctggaaccgcgtgtggatcgaggagaacccgtggatggaggacaagacccacgtgtccagctgggaggaggtcccctacctcgggaagcgggaggaccagtggtgcggctccctgatcggcctgaccgcccgcgcgacctgggccacgaacatccaggtggccatcaaccaggtgcggcgcctcatcgggaacgagaactacctggactacatgaccagcatgaagcggttcaagaacgagtccgaccccgagggcgccctgtggtga

SEQ ID NO: 8206 - RNA, 9879 nt, synthetic construct
  misc_feature 1..9879: note = derived and/or modified CDS sequence (opt1) from DENV-1__FJ390379__SS-prME
  source 1..9879: mol_type = other RNA
agcgtgaccatgctgctcatgctgctgcccaccgccctcgccttccacctgaccacccggggcggggagccccacatgatcgtgtccaagcaggagcggggcaagagcctcctgttcaagacctccgccgggatcaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtcgccctggcgccccacgtgggcctggggctcgagacccgcaccgagacctggatgagctccgagggcgcctggaagcagatccagaaggtggagacctgggccctgcggcaccccgggttcacggtcaccgccctgttcctcgcgcacgccatcggcaccagcatcacccagaaggggatcatcttcatcctgctgatgctcgtgacgccctccatggccatgcgctgcgtgggcatcggcaaccgggacttcgtcgaggggctgagcggcgccacctgggtggacgtggtcctggagcacgggtcctgcgtgaccaccatggccaaggacaagcccacgctcgacatcgagctgctgaagaccgaggtgaccaaccccgcggtcctccgcaagctgtgcatcgaggccaagatcagcaacaccacgaccgactcccggtgcccgacccagggcgaggccaccctggtggaggagcaggacagcaacttcgtgtgccgccggacgttcgtcgaccgcggctgggggaacggctgcggcctcttcggcaaggggtccctgctgacctgcgccaagttcaagtgcgtgaccaagctcgagggcaagatcgtgcagtacgagaacctgaagtacagcgtcatcgtgaccgtgcacacgggcgaccagcaccaggtcgggaacgagaccaccgagcacggcaccatcgccaccatcacgccccaggcgcccacctccgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggaccagcggggccagcacctcccaggagacgtggaaccgccaggacctcctggtgaccttcaagaccgcccacgccaagaagcaggaggtggtcgtgctgggcagccaggagggcgcgatgcacaccgccctcacgggggccaccgagatccagacctccggcaccacgaccatcttcgccgggcacctgaagtgccggctgaagatggacaagctcaccctgaagggcatgagctacgtgatgtgcaccgggtccttcaagctggagaaggaggtcgccgagacgcagcacggcaccgtgctggtgcaggtcaagtacgagggcaccgacgcgccctgcaagatccccttcagcgcccaggacgagaagggggtgacccagaacggccgcctcatcacggccaacccgatcgtgaccgacaaggagaagcccgtcaacatcgagaccgagccgcccttcggggagtcctacatcgtggtgggcgccggcgagaaggcgctgaagctgagctggttcaagaaggggtccagcatcggcaagatgttcgaggccaccgcccgcggggcccgccggatggccatcctcggcgacacggcgtgggacttcgggtccatcggcggcgtcttcaccagcgtggggaagctggtgcaccaggtcttcggcgccgcctacggggtgctgttctccggcgtgagctggaccatgaagatcgggatcggcatcctcctgacctggctgggcctcaactcccgcagcacgtccctgagcatgacctgcatcgccgtcgggatggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggcggacagcccgaagcggctgtccgccgccatcggcaaggcctgggaggagggggtgtgcggcatccgcagcgccacccggctcgagaacatcatgtggaagcagatctccaacgagctgaaccacatcctgctcgagaacgacatgaagttcaccgtggtcgtgggggacgcgaacggcatcctggcccaggggcgcaagatgatccggccccagcccatggagcaccgctacagctggaagtcctggggcaaggccaagatcatcggcgccgacatccagaacagcaccttcatcatcgacgggcccgacacgccggagtgccccgacgaccagcgggcgtggaacatctgggaggtggaggactacggcttcgggatcttcaccaccaacatctggctgaagctccgcgactcctacacccagatgtgcgaccaccggctgatgagcgccgccatcaaggactccaaggccgtccacgccgacatgggctactggatcgagagcgagaagaacgagacgtggaagctggcgcgcgcctccttcatcgaggtgaagacctgcatctggcccaagagccacaccctctggtccaacggcgtgctggagagcgagatgatcatccccaagatctacgggggcccgatctcccagcacaactaccggcccgggtacttcacccagacggccggcccctggcacctggggaagctcgagctggacttcgacctgtgcgagggcaccaccgtcgtggtggacgagcactgcggcaaccgcgggccgagcctccggaccacgaccgtcaccggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtcagcgccggctccggcgaggtggacagcttctccctggggatcctgtgcgtgagcatcatgatcgaggaggtcatgcggtcccgctggagccgcaagatgctcatgacgggcaccctggccgtgttcctgctcctgatcatggggcagctgacctggaacgacctcatccggctgtgcatcatggtgggcgcgaacgcctccgaccgcatggggatgggcaccacgtacctggccctcatggccaccttcaagatgcggccgatgttcgccgtcgggctgctgttccgccggctcaccagccgcgaggtgctgctgctcaccatcgggctgtccctggtggcgagcgtcgagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggcggaccatggccatggtgctgagcatcgtctccctgttccccctctgcctgagcaccacgtcccagaagaccacctggctgccggtgctcctgggcagcttcgggtgcaagcccctgaccatgttcctcatcacggagaacaagatctggggccgcaagtcctggcccctgaacgaggggatcatggcgatcggcatcgtgagcatcctgctcagctccctgctgaagaacgacgtccccctcgccgggccgctgatcgccggcggcatgctgatcgcctgctacgtgatcagcgggtccagcgccgacctctccctggagaaggcggccgaggtgagctgggaggaggaggccgagcactccggcaccagccacaacatcctggtcgaggtgcaggacgacgggaccatgaagatcaaggacgaggagcgggacgacaccctcaccatcctgctgaaggccacgctcctggccatctccggcgtgtaccccatgagcatccccgcgaccctgttcgtctggtacttctggcagaagaagaagcagcgctccggggtgctctgggacacccccagcccgcccgaggtggagcgggccgtcctggacgacggcatctaccgcatcctgcagcggggcctgctcgggcgctcccaggtgggcgtgggggtcttccaggacggcgtgttccacaccatgtggcacgtgacgcgcggggccgtcctgatgtaccagggcaagcgcctggagcccagctgggcctccgtgaagaaggacctcatcagctacggcgggggctggcggttccaggggtcctggaacaccggcgaggaggtgcaggtcatcgccgtggagcccgggaagaacccgaagaacgtgcagaccacccccggcacgttcaagacccccgagggcgaggtcggggcgatcgccctggacttcaagcccggcaccagcgggtccccgatcgtgaaccgcgagggcaagatcgtgggcctgtacgggaacggcgtcgtgaccacgagcgggacctacgtgagcgccatcgcccaggccaagacctcccaggagggccccctccccgagatcgaggaggaggtcttcaagaagcggaacctgaccatcatggacctgcacccggggagcggcaagacgcgccggtacctccccgcgatcgtgcgcgaggccatcaagcgcaagctgcggaccctgatcctcgcccccacccgcgtggtcgcctccgagatggcggaggccctgaagggcatgcccatccggtaccagaccacggccgtcaagagcgagcacaccgggcgcgagatcgtggacctgatgtgccacgccaccttcaccatgcggctcctgtccccggtccgcgtgcccaactacaacatgatcatcatggacgaggcccacttcacggaccccgcgagcatcgccgcccggggctacatctccacccgcgtggggatgggcgaggccgccgcgatcttcatgaccgccacgccgcccgggagcgtcgaggccttcccccagtccaacgccgtgatccaggacgaggagcgggacatccccgagcgcagctggaactccggctacgactggatcacggacttccccggcaagaccgtgtggttcgtccccagcatcaagtccgggaacgacatcgccaactgcctgcggaagaacggcaagcgcgtgatccagctcagccggaagaccttcgacaccgagtaccagaagacgcgcaacaacgactgggactacgtggtcaccaccgacatctccgagatgggggcgaacttccgggccgaccgcgtgatcgacccccggcgctgcctgaagcccgtgatcctgaaggacggccccgagcgggtcatcctcgccgggccgatgcccgtgaccgtggccagcgcggcccagcgccgcggccggatcggccgcaaccagaacaaggagggggaccagtacgtctacatgggccagcccctgaacaacgacgaggaccacgcccactggacggaggccaagatgctgctcgacaacatcaacacccccgaggggatcatcccggccctgttcgagcccgagcgggagaagtccgcggccatcgacggcgagtaccgcctgcgcggggaggcccgcaagaccttcgtggagctcatgcggcgcggcgacctgcccgtctggctgagctacaaggtggcctccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcccggacgtacagcgacccgctcgcgctgcgcgagttcaaggagttcgccgccgggcggcgctccgtgagcggcgacctgatcctcgagatcggcaagctgccccagcacctgaccctccgggcccagaacgccctggacaacctggtgatgctccacaactccgagcagggcgggaaggcgtaccgccacgccatggaggagctgcccgacaccatcgagaccctgatgctcctggccctgatcgccgtcctcaccgggggcgtgacgctgttcttcctgagcgggaagggcctcggcaagacctccatcgggctgctgtgcgtgatggcgagctccgccctcctgtggatggccaacgtcgagccccactggatcgccgccagcatcatcctggagttcttcctcatggtgctgctgatcccggagcccgaccggcagcgcacgccccaggacaaccagctcgcgtacgtggtcatcggcctgctgttcatgatcctcaccgtggccgccaacgagatggggctgctggagacgaccaagaaggacctcggcatcgggcacgtggccgccgagaaccagcaccacgcgaccatgctggacgtcgacctgcgcccggcctccgcctggaccctctacgccgtggccacgaccgtgatcacccccatgatgcggcacaccatcgagaacacgaccgcgaacatcagcctgaccgccatcgccaaccaggccgccatcctgatgggcctcgacaagggctggcccatctccaagatggacatcggggtccccctgctggcgctcggctgctacagccaggtgaacccgctgaccctgacggccgccgtgctcatgctggtcgcccactacgcgatcatcgggcccggcctgcaggccaaggccacccgcgaggcccagaagcggaccgccgcggggatcatgaagaaccccaccgtggacggcatcgtggccatcgacctcgaccccgtcgtgtacgacgccaagttcgagaagcagctgggccagatcatgctgctcatcctgtgcacgtcccagatcctgctcatgcgcaccacctgggccctgtgcgagagcatcaccctggccacggggccgctcaccaccctgtgggagggctcccccgggaagttctggaacaccacgatcgcggtgagcatggccaacatcttccggggctcctacctggccggcgccgggctcgccttcagcctgatgaagtccctgggcgggggccgccgggggaccggcgcgcagggcgagaccctcggggagaagtggaagcgccagctgaaccagctgagcaagagcgagttcaacacctacaagcggtccggcatcatggaggtcgaccgcagcgaggccaaggaggggctcaagcggggcgagacgaccaagcacgccgtgtcccgcgggaccgccaagctgcggtggttcgtggagcgcaacctggtcaagcccgagggcaaggtgatcgacctgggctgcgggcggggcgggtggagctactactgcgcgggcctcaagaaggtgaccgaggtcaaggggtacacgaagggcggccccgggcacgaggagccggtgcccatggccacctacggctggaacctggtgaagctgtactccgggaaggacgtcttcttcacgccgcccgagaagtgcgacaccctcctgtgcgacatcggcgagagctccccgaaccccaccatcgaggaggggcgcacgctgcgggtgctcaagatggtggagccctggctgcgcggcaaccagttctgcatcaagatcctgaacccctacatgccgagcgtcgtggagaccctcgagcagatgcagcggaagcacggcgggatgctggtgcgcaaccccctgtcccgcaacagcacccacgagatgtactgggtctcctgcggcaccgggaacatcgtgagcgccgtgaacatgacgtcccggatgctcctgaaccgcttcaccatgacccaccggaagcccacctacgagcgcgacgtcgacctgggcgccggcacgcggcacgtggccgtggagcccgaggtcgcgaacctcgacatcatcgggcagcgcatcgagaacatcaagaacgagcacaagagcacctggcactacgacgaggacaacccgtacaagacctgggcctaccacggctcctacgaggtgaagcccagcgggtccgccagctccatggtgaacggcgtcgtgcggctgctgaccaagccctgggacgtcatccccatggtgacgcagatcgccatgaccgacaccaccccgttcgggcagcagcgcgtgttcaaggagaaggtcgacacgcggacgccccgggccaagcggggcaccgcgcagatcatggaggtgaccgccaagtggctctggggcttcctgagccgcaacaagaagccccggatctgcacgcgcgaggagttcacccggaaggtgcgcagcaacgccgccatcggggccgtcttcgtggacgagaaccagtggaactccgcgaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggccaagggcagccgggcgatctggtacatgtggctgggcgcccgcttcctcgagttcgaggccctggggttcatgaacgaggaccactggttctcccgcgagaacagcttctccggcgtggagggggagggcctgcacaagctcgggtacatcctgcgggacatcagcaagatcccgggcggcaacatgtacgccgacgacaccgccgggtgggacacgcgcatcaccgaggacgacctgcagaacgaggcgaagatcaccgacatcatggagcccgagcacgccctcctggccacctccatcttcaagctgacgtaccagaacaaggtcgtgcgggtgcagcgccccgccaagaacggcaccgtcatggacgtgatcagccggcgcgaccagcgggggtccggccaggtgggcacctacgggctcaacaccttcacgaacatggaggtccagctgatccgccagatggagagcgagggcatcttcctgccctccgagctcgagaccccgaacctggccgagcgggtgctggactggctcgagaagcacgggaccgagcgcctgaagcggatggcgatcagcggcgacgactgcgtggtcaagcccgtggacgaccgcttcgccaccgccctgatcgccctcaacgacatggggaaggtgcggaaggacatcccccagtgggagccctccaagggctggaacgactggcagcaggtcccgttctgcagccaccacttccaccagctgatcatgaaggacggccgcgagatcgtggtgccctgccggaaccaggacgagctggtcgggcgcgcccgggtgtcccagggcgcggggtggagcctccgcgagacggcctgcctgggcaagtcctacgcccagatgtggcagctgatgtacttccaccggcgcgacctccgcctggccgccaacgcgatctgcagcgccgtgcccgtcgactgggtgcccaccagccggaccacctggtccatccacgcccaccaccagtggatgaccacggaggacatgctgagcgtgtggaaccgcgtctggatcgaggagaacccgtggatggaggacaagacccacgtgtccagctgggaggaggtgccctacctcgggaagcgggaggaccagtggtgcggctccctgatcggcctgaccgcccgcgcgacctgggccacgaacatccaggtcgccatcaaccaggtgcggcgcctcatcgggaacgagaactacctggactacatgaccagcatgaagcggttcaagaacgagtccgaccccgagggcgccctgtggtga

SEQ ID NO: 8207 - RNA, 9879 nt, synthetic construct
  misc_feature 1..9879: note = derived and/or modified CDS sequence (opt1) from DENV-1__FJ390380__SS-prME
  source 1..9879: mol_type = other RNA
agcgtgaccatgctgctcatgctgctgcccaccgccctcgccttccacctgaccacccggggcggggagccccacatgatcgtgtccaagcaggagcggggcaagagcctcctgttcaagacctccgccgggatcaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtcgccctggcgccccacgtgggcctggggctcgagacccgcaccgagacctggatgagctccgagggcgcctggaagcagatccagaaggtggagacctgggccctgcggcaccccgggttcacggtgaccgccctgttcctcgcgcacgccatcggcaccagcatcacccagaaggggatcatcttcatcctgctgatgctcgtgacgccctccatggccatgcgctgcgtgggcatcggcaaccgggacttcgtcgaggggctgagcggcgccacctgggtggacgtggtcctggagcacgggtcctgcgtgaccaccatggccaaggacaagcccacgctcgacatcgagctgctgaagaccgaggtgaccaaccccgcggtcctccgcaagctgtgcatcgaggccaagatcagcaacaccacgaccgactcccggtgcccgacccagggcgaggccaccctggtggaggagcaggacagcaacttcgtgtgccgccggacgttcgtcgaccgcggctgggggaacggctgcggcctgttcggcaaggggtccctgctgacctgcgccaagttcaagtgcgtgaccaagctcgagggcaagatcgtgcagtacgagaacctgaagtacagcgtcatcgtgaccgtgcacacgggcgaccagcaccaggtcgggaacgagaccaccgagcacggcaccatcgccaccatcacgccccaggcgcccacctccgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggaccagcggggccagcacctcccaggagacgtggaaccgccaggacctcctggtgaccttcaagaccgcccacgccaagaagcaggaggtggtcgtgctgggcagccaggagggcgcgatgcacaccgccctcacgggggccaccgagatccagacctccggcaccacgaccatcttcgccgggcacctgaagtgccggctgaagatggacaagctcaccctgaagggcatgagctacgtgatgtgcaccgggtccttcaagctggagaaggaggtcgccgagacgcagcacggcaccgtgctggtgcaggtcaagtacgagggcaccgacgcgccctgcaagatccccttcagcgcccaggacgagaagggggtgacccagaacggccgcctcatcacggccaacccgatcgtgaccgacaaggagaagcccgtcaacatcgagaccgagccgcccttcggggagtcctacatcgtggtgggcgccggcgagaaggcgctgaagctgagctggttcaagaaggggtccagcatcggcaagatgttcgaggccaccgcccgcggggcccgccggatggccatcctcggcgacacggcgtgggacttcgggtccatcggcggcgtcttcaccagcgtggggaagctggtgcaccaggtcttcggcgccgcctacggggtgctgttctccggcgtgagctggaccatgaagatcgggatcggcatcctcctgacctggctgggcctcaactcccgcagcacgtccctgagcatgacctgcatcgccgtcgggatggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggcggacagcccgaagcggctgtccgccgccatcggcaaggcctgggaggagggggtgtgcggcatccgcagcgccacccggctcgagaacatcatgtggaagcagatctccaacgagctgaaccacatcctgctcgagaacgacatgaagttcaccgtggtcgtgggggacgcgaacggcatcctggcccaggggaagaagatgatccgcccccagcccatggagcaccggtacagctggaagtcctggggcaaggccaagatcatcggcgccgacatccagaacagcaccttcatcatcgacgggcccgacacgccggagtgccccgacgaccagcgcgcgtggaacatctgggaggtggaggactacggcttcgggatcttcaccaccaacatctggctgaagctccgggactcctacacccagatgtgcgaccaccgcctgatgagcgccgccatcaaggactccaaggccgtccacgccgacatgggctactggatcgagagcgagaagaacgagacgtggaagctggcgcgggcctccttcatcgaggtgaagacctgcatctggcccaagagccacaccctctggtccaacggcgtgctggagagcgagatgatcatccccaagatctacgggggcccgatctcccagcacaactaccgccccgggtacttcacccagacggccggcccctggcacctggggaagctcgagctggacttcgagctgtgcgagggcaccaccgtcgtggtggacgagcactgcggcaaccgggggccgagcctccgcaccacgaccgtcaccggcaagatcatccacgagtggtgctgccggtcctgcaccctgccgcccctgcgcttccgcggggaggacggctgctggtacgggatggagatccgccccgtgaaggagaaggaggagaacctcgtgcggagcatggtcagcgccggctccggcgaggtggacagcttctccctggggatcctgtgcgtgagcatcatgatcgaggaggtcatgcgctcccggtggagccgcaagatgctcatgacgggcaccctggtggtgttcttcctgctcatcatggggcagctgacctggaacgacctgatccgcctctgcatcatggtcggcgccaacgcgtccgaccggatggggatgggcaccacgtacctggccctgatggccaccttcaagatgcgcccgatgttcgccgtggggctcctgttccggcgcctgaccagccgggaggtgctcctgctgaccatcgggctctccctggtcgccagcgtggagctgcccaactccctcgaggagctgggcgacgggctggcgatgggcatcatgatgctcaagctgctgacggagttccagccccaccagctctggaccaccctgctgagcctcaccttcatcaagacgaccctgtccctggactacgcctggcgcaccatggccatggtcctcagcatcgtgtccctgttccccctgtgcctcagcaccacgtcccagaagaccacctggctgccggtgctgctcggcagcttcgggtgcaagcccctgaccatgttcctgatcacggagaacaagatctggggccggaagtcctggcccctcaacgaggggatcatggccatcggcatcgtcagcatcctgctgagctccctcctgaagaacgacgtgcccctggcggggccgctcatcgccggcggcatgctgatcgcctgctacgtgatcagcgggtccagcgccgacctgtccctcgagaaggccgcggaggtcagctgggaggaggaggccgagcactccggcaccagccacaacatcctggtggaggtgcaggacgacgggaccatgaagatcaaggacgaggagcgcgacgacaccctgaccatcctcctgaaggccacgctgctcgccgtctccggcgtgtaccccatgagcatccccgccaccttcttcgtgtggtacttctggcagaagaagaagcagcggtccggggtcctgtgggacacccccagcccgcccgaggtggagcgcgcggtgctggacgacggcatctaccggatcctccagcgcggcctgctggggcggtcccaggtcggcgtgggggtgttccaggacggcgtcttccacaccatgtggcacgtgacgcgcggggccgtgctgatgtaccagggcaagcggctcgagcccagctgggcctccgtcaagaaggacctgatcagctacggcgggggctggcgcttccaggggtcctggaacaccggcgaggaggtccaggtgatcgccgtcgagcccgggaagaacccgaagaacgtgcagaccacccccggcacgttcaagacccccgagggcgaggtgggggccatcgcgctggacttcaagcccggcaccagcgggtccccgatcgtcaaccgggagggcaagatcgtgggcctctacgggaacggcgtggtcaccacgagcgggacctacgtgagcgccatcgcccaggccaagacctcccaggagggccccctgcccgagatcgaggaggaggtgttcaagaagcgcaacctgaccatcatggacctccacccggggagcggcaagacgcggcgctacctgcccgccatcgtccgggaggcgatcaagcgcaagctgcgcaccctcatcctggcccccacccgggtggtggcctccgagatggccgaggcgctgaagggcatgcccatccgctaccagaccacggccgtcaagagcgagcacaccgggcgggagatcgtggacctcatgtgccacgccaccttcaccatgcgcctgctgtccccggtgcgggtccccaactacaacatgatcatcatggacgaggcccacttcacggaccccgccagcatcgcggcccgcggctacatctccacccgggtggggatgggcgaggccgccgccatcttcatgaccgcgacgccgcccgggagcgtggaggccttcccccagtccaacgccgtcatccaggacgaggagcgcgacatccccgagcggagctggaactccggctacgactggatcacggacttccccggcaagaccgtgtggttcgtgcccagcatcaagtccgggaacgacatcgccaactgcctccgcaagaacggcaagcgggtcatccagctgagccgcaagaccttcgacaccgagtaccagaagacgcggaacaacgactgggactacgtggtgaccaccgacatctccgagatgggggccaacttccgcgcggaccgggtcatcgacccccgccggtgcctgaagcccgtgatcctcaaggacggccccgagcgcgtgatcctggccgggccgatgcccgtcaccgtggccagcgccgcgcagcggcgcggccgcatcggccggaaccagaacaaggagggggaccagtacgtctacatgggccagcccctgaacaacgacgaggaccacgcccactggacggaggccaagatgctcctggacaacatcaacacccccgaggggatcatcccggccctgttcgagcccgagcgcgagaagtccgccgcgatcgacggcgagtaccggctccgcggggaggcccggaagaccttcgtggagctgatgcgccggggcgacctgcccgtgtggctcagctacaaggtcgcctccgagggcttccagtacagcgaccgccggtggtgcttcgacggggagcgcaacaaccaggtgctggaggagaacatggacgtggagatctggaccaaggagggcgagcggaagaagctgcgcccccggtggctcgacgcccgcacgtacagcgacccgctggccctgcgggagttcaaggagttcgcggccgggcgccggtccgtcagcggcgacctcatcctggagatcggcaagctgccccagcacctcaccctgcgcgcccagaacgccctggacaacctcgtgatgctgcacaactccgagcagggcgggaaggcctaccggcacgcgatggaggagctgcccgacaccatcgagaccctcatgctgctggccctcatcgccgtgctgaccgggggcgtcacgctgttcttcctcagcgggaagggcctgggcaagacctccatcgggctgctctgcgtgatggccagctccgcgctgctgtggatggccaacgtggagccccactggatcgccgccagcatcatcctcgagttcttcctgatggtcctgctcatcccggagcccgaccgccagcggacgccccaggacaaccagctggcctacgtggtgatcggcctcctcttcatgatcctgaccgtcgcggccaacgagatggggctgctcgagacgaccaagaaggacctgggcatcgggcacgtggccgccgagaaccagcaccacgccaccatgctggacgtggacctccgcccggcgtccgcctggaccctgtacgccgtcgccacgaccgtgatcacccccatgatgcgccacaccatcgagaacacgaccgccaacatcagcctgaccgcgatcgccaaccaggccgccatcctcatgggcctggacaagggctggcccatctccaagatggacatcggggtgcccctgctcgccctgggctgctacagccaggtcaacccgctgaccctcacggcggccgtgctgatgctggtggcccactacgccatcatcgggcccggcctccaggcgaaggccacccgggaggcccagaagcgcaccgccgccgggatcatgaagaaccccaccgtcgacggcatcgtggcgatcgacctggaccccgtggtctacgacgccaagttcgagaagcagctgggccagatcatgctcctgatcctgtgcacgtcccagatcctcctgatgcggaccacctgggccctgtgcgagagcatcaccctcgccacggggccgctgaccaccctgtgggagggctcccccgggaagttctggaacaccacgatcgccgtgagcatggcgaacatcttccgcggctcctacctcgccggcgccgggctggccttcagcctgatgaagtccctcggcgggggccggcgcgggaccggcgcccagggcgagaccctgggggagaagtggaagcggcagctgaaccagctcagcaagagcgagttcaacacctacaagcgctccggcatcatggaggtggaccggagcgaggcgaaggaggggctgaagcgcggcgagacgaccaagcacgccgtctcccgggggaccgccaagctgcgctggttcgtggagcggaacctcgtgaagcccgagggcaaggtcatcgacctgggctgcgggcgcggcgggtggagctactactgcgccggcctgaagaaggtgaccgaggtgaaggggtacacgaagggcggccccgggcacgaggagccgatccccatggcgacctacggctggaacctggtcaagctctactccgggaaggacgtgttcttcacgccgcccgagaagtgcgacaccctgctgtgcgacatcggcgagagctccccgaaccccaccatcgaggaggggcggacgctccgcgtgctgaagatggtcgagccctggctgcggggcaaccagttctgcatcaagatcctcaacccctacatgccgagcgtggtggagaccctggagcagatgcagcgcaagcacggcgggatgctggtccggaaccccctctcccgcaacagcacccacgagatgtactgggtgtcctgcggcaccgggaacatcgtgagcgccgtcaacatgacgtcccgcatgctgctgaaccggttcaccatgacccaccgcaagcccacctacgagcgggacgtggacctcggcgccggcacgcgccacgtggccgtcgagcccgaggtggccaacctggacatcatcgggcagcggatcgagaacatcaagaacgagcacaagagcacctggcactacgacgaggacaacccgtacaagacctgggcgtaccacggctcctacgaggtgaagcccagcgggtccgccagctccatggtcaacggcgtggtccgcctgctcaccaagccctgggacgtgatccccatggtgacgcagatcgccatgaccgacaccaccccgttcgggcagcagcgggtcttcaaggagaaggtggacacgcgcacgccccgggccaagcgcggcaccgcccagatcatggaggtgaccgcgaagtggctgtggggcttcctgagccggaacaagaagccccgcatctgcacgcgggaggagttcacccgcaaggtccggagcaacgccgccatcggggccgtgttcgtggacgagaaccagtggaactccgccaaggaggcggtcgaggacgagcgcttctgggacctcgtgcaccgggagcgcgagctgcacaagcagggcaagtgcgcgacctgcgtgtacaacatgatggggaagcgggagaagaagctgggcgagttcgggaaggccaagggcagccgcgccatctggtacatgtggctcggcgcgcggttcctggagttcgaggccctggggttcatgaacgaggaccactggttctcccgcgagaacagcttctccggcgtcgagggggagggcctccacaagctggggtacatcctgcgcgacatcagcaagatcccgggcggcaacatgtacgccgacgacaccgccgggtgggacacgcggatcaccgaggacgacctccagaacgaggccaagatcaccgacatcatggagcccgagcacgcgctgctggccacctccatcttcaagctcacgtaccagaacaaggtggtgcgcgtccagcggcccgccaagaacggcaccgtgatggacgtgatcagccgccgggaccagcgcgggtccggccaggtcggcacctacgggctgaacaccttcacgaacatggaggtgcagctgatccggcagatggagagcgagggcatcttcctcccctccgagctggagaccccgaacctggccgagcgcgtgctcaactggctggagaagcacgggaccgagcggctgaagcgcatggccatcagcggcgacgactgcgtcgtgaagcccgtggacgaccggttcgcgaccgccctcatcgccctgaacgacatggggaaggtccgcaaggacatcccccagtgggagccctccaagggctggaacgactggcagcaggtcccgttctgcagccaccacttccaccagctgatcatgaaggacggccgggagatcgtggtcccctgccgcaaccaggacgagctcgtggggcgggcccgcgtgtcccagggcgccgggtggagcctgcgggagacggcgtgcctgggcaagtcctacgcccagatgtggcagctcatgtacttccaccgccgggacctgcgcctggccgccaacgccatctgcagcgcggtccccgtggactgggtgcccaccagccgcaccacctggtccatccacgcccaccaccagtggatgaccacggaggacatgctcagcgtctggaaccgggtgtggatcgaggagaacccgtggatggaggacaagacccacgtgtccagctgggaggaggtcccctacctggggaagcgcgaggaccagtggtgcggctccctgatcggcctcaccgcccgggccacctgggcgacgaacatccaggtggccatcaaccaggtgcgccggctgatcgggaacgagaactacctggactacatgaccagcatgaagcgcttcaagaacgagtccgaccccgagggcgccctctggtga

SEQ ID NO: 8208 - RNA, 9879 nt, synthetic construct
  misc_feature 1..9879: note = derived and/or modified CDS sequence (opt1) from DENV-1__FJ205874__SS-prME
  source 1..9879: mol_type = other RNA
agcgtgaccatgctgctcatgctgctgcccaccgtgctcgccttccacctgaccacccggggcggggagccccacatgatcgtgggcaagcaggagcggggcaagagcctcctgttcaagaccagcgccggggtgaacatgtgcaccctgatcgccatggacctgggggagctctgcgaggacaccatgacctacaagtgcccccgcatcaccgaggccgagcccgacgacgtggactgctggtgcaacgccaccgacacctgggtgacctacgggacctgctcccagaccggcgagcaccggcgggacaagcggagcgtggccctggcgccccacgtcgggctgggcctcgagacccgcaccgagacctggatgtccagcgagggggcctggaagcagatccagaaggtggagacctgggccctgcggcaccccggcttcaccgtgatcgccttcttcctggcccacgcgatcgggacctccatcacccagaagggcatcatcttcatcctcctgatgctggtcacccccagcatggccatgcgctgcgtgggcatcgggaaccgggacttcgtggagggcctctccggggccacgtgggtcgacgtggtgctggagcacggcagctgcgtcaccaccatggccaagaacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcgggtggggcaacgggtgcggcctgttcgggaagggctccctcctgacgtgcgccaagttcaagtgcgtcaccaagctggagggcaagatcgtgcagtacgagaacctcaagtacagcgtgatcgtcaccgtgcacaccggggaccagcaccaggtcggcaacgagacgaccgagcacgggaccatcgccaccatcacgccccaggcgcccacgtccgagatccagctgaccgactacggcgccctgaccctcgactgcagcccccggaccgggctggacttcaacgagatggtgctgctcacgatgaaggagaagtcctggctggtgcacaagcagtggttcctggacctcccgctgccctggaccagcggcgcctccaccagccaggagacctggaaccgccaggacctgctcgtcacgttcaagaccgcccacgccaagaagcaggaggtggtggtcctgggcagccaggagggggcgatgcacaccgccctgaccggcgccacggagatccagacctccgggaccaccacgatcttcgccggccacctcaagtgccggctgaagatggacaagctgaccctcaaggggatgagctacgtgatgtgcaccggctccttcaagctggagaaggaggtggccgagacccagcacggcacggtcctggtccaggtgaagtacgaggggaccgacgcgccctgcaagatccccctgagcacccaggacgagaagggcgtcacccagaacgggcgcctcatcacggccaacccgatcgtgaccgacaaggagaagcccgtgaacatcgagaccgagccgcccttcggcgagtcctacatcatcgtcggcgccggggagaaggccctgaagctgagctggttcaagaagggctccagcatcgggaagatgttcgaggcgaccgcccggggcgcccgccggatggccatcctcggggacacggcctgggacttcggctccatcggcggggtgttcaccagcgtgggcaagctggtccaccaggtgttcgggaccgcgtacggcgtgctgttctccggggtcagctggaccatgaagatcggcatcggcatcctcctgacgtggctggggctcaactcccgcagcgcctccctgagcatgacctgcatcgccgtgggcatggtgaccctgtacctcggggtcatggtgcaggccgactccggctgcgtgatcaactggaaggggcgcgagctgaagtgcggcagcggcatcttcgtcaccaacgaggtgcacacgtggaccgagcagtacaagttccaggccgactccccgaagcggctgagcgcggccatcgggaaggcctgggaggagggcgtgtgcggggtccgcagcgccacccggctcgagaacatcatgtggaagcagatctccaacgagctgaaccacatcctgctcgagaacgacatgaagttcaccgtggtggtcggcgacgccaacgggatcctggcgcagggcaagaagatgatccgcccccagcccatggagcacaagtacagctggaagtcctggggcaaggccaagatcatcggggccgacatccagaacaccacgttcatcatcgacggccccgacaccccggagtgccccgacgaccagcgggcctggaacatctgggaggtggaggactacgggttcggcatcttcaccaccaacatctggctgaagctccgcgacagctacacgcagatgtgcgaccaccggctgatgtccgcggccatcaaggacagcaaggccgtgcacgccgacatgggctactggatcgagtccgagaagaacgagacctggcgcctggcccgggcgagcttcatcgaggtcaagacctgcatctggcccaagtcccacaccctctggagcaacggggtgctggagtccgagatgatcatccccaagatctacggcgggccgatcagccagcacaactaccgccccggctacttcacgcagaccgccgggccctggcacctgggcaagctcgagctggacttcgacctgtgcgagggcaccaccgtggtcgtggacgagcactgcgggaaccggggcccgtccctccgcacgaccaccgtgaccgggaagatcatccacgagtggtgctgccggagctgcacgctgccgcccctgcgcttccggggcgaggacgggtgctggtacggcatggagatccgccccgtcaaggagaaggaggagaacctcgtgcggtccatggtgagcgccggctccggggaggtcgacagcttcagcctgggcatcctgtgcctctccatcatgatcgaggaggtgatgcgcagccggtggtcccgcaagatgctgatgaccgggaccctggccgtgttcctcctgctgatcatgggccagctcacctggaacgacctgatccgcctgtgcatcatggtcggggccaacgcgagcgaccggatgggcatgggcacgacctacctcgccctgatggccaccttcaagatgcgcccgatgttcgccgtggggctcctgttccggcgcctgacctcccgggaggtgctgctcctgacgatcggcctgagcctcgtcgcctccgtggagctgcccaacagcctggaggagctcggggacggcctggcgatgggcatcatgatgctgaagctcctgaccgagttccagccccaccagctgtggaccaccctcctgtccctgacgttcatcaagaccaccctcagcctggactacgcctggaagaccatggccatggtcctgtccatcgtgagcctcttccccctgtgcctgtccacgaccagccagaagaccacctggctcccggtgctgctggggtccttcggctgcaagcccctcacgatgttcctgatcaccgagaacaagatctgggggcgcaagagctggcccctgaacgagggcatcatggccatcgggatcgtctccatcctcctgagctccctgctcaagaacgacgtgcccctggcgggcccgctgatcgccggcgggatgctcatcgcctgctacgtgatcagcggcagctccgccgacctgagcctggagaaggccgcggaggtctcctgggaggaggaggccgagcacagcgggacctcccacaacatcctcgtggaggtgcaggacgacggcaccatgaagatcaaggacgaggagcgggacgacaccctgacgatcctgctcaaggccaccctgctggccgtcagcggggtgtaccccatgtccatccccgccaccctcttcgtgtggtacttctggcagaagaagaagcagcgcagcggcgtcctgtgggacaccccctccccgcccgaggtggagcgggcggtgctggacgacggcatctaccgcatcctgcagcgggggctcctgggccgcagccaggtcggggtgggcgtgttccaggacggggtcttccacacgatgtggcacgtgacccggggcgccgtgctgatgtaccagggcaagcgcctcgagccctcctgggccagcgtcaagaaggacctgatctcctacgggggcgggtggcggttccagggcagctggaacaccggggaggaggtccaggtgatcgccgtcgagcccggcaagaacccgaagaacgtgcagaccacgcccggcaccttcaagacccccgagggggaggtgggcgccgtcgcgctggacttcaagcccgggacctccggcagcccgatcgtgaaccgcgagggcaagatcgtggggctctacggcaacggggtcgtgacgacctccggcacctacgtgagcgccatcgcccaggccaaggcctcccaggaggggcccctgcccgagatcgaggacgaggtcttcaagaagcggaacctgaccatcatggacctccacccgggcagcggcaagacgcgccggtacctgcccgcgatcgtgcgcgaggccatcaagcggaagctgcgcaccctcatcctggcccccacccgcgtggtcgccagcgagatggcggaggccctgaaggggatgcccatccggtaccagaccacggccgtgaagtccgagcacaccggccgcgagatcgtggacctcatgtgccacgccaccttcaccatgcggctgctgagcccggtccgcgtgcccaactacaacatgatcatcatggacgaggcccacttcacggaccccgcgtccatcgccgcccgggggtacatcagcacccgcgtgggcatgggggaggccgccgcgatcttcatgaccgccacgccgcccggctccgtcgaggccttcccccagagcaacgccgtgatccaggacgaggagcgggacatccccgagcgctcctggagctccggctacgactggatcacggacttccccgggaagaccgtgtggttcgtccccagcatcaagtccggcaacgacatcgccaactgcctccggaagaacgggaagcgcgtgatccagctgagccggaagaccttcgacaccgagtaccagaagacgaagaacaacgactgggactacgtggtcaccaccgacatctccgagatgggcgcgaacttccgcgccgaccgggtgatcgacccccgccggtgcctgaagcccgtgatcctcaaggacgggcccgagcgcgtcatcctggccggcccgatgcccgtgaccgtcgccagcgcggcccagcggcgcggccggatcgggcgcaaccagaacaaggagggcgaccagtacgtgtacatggggcagcccctgaacaacgacgaggaccacgcccactggacggaggccaagatgctcctggacaacatcaacacccccgagggcatcatcccggccctgttcgagcccgagcgcgagaagtccgcggccatcgacggggagtaccggctccgcggcgaggcccggaagaccttcgtggagctgatgaagcgcggcgacctgcccgtctggctcagctacaaggtggcctccgaggggttccagtacagcgaccggcgctggtgcttcgacggcgagcggaacaaccaggtgctggaggagaacatggacgtcgagatctggaccaaggagggggagcgcaagaagctgcggccccgctggctcgacgcccggacgtactccgacccgctggcgctgcgcgagttcaaggagttcgccgccggccggcgcagcgtgagcggcgacctcatcctggagatcgggaagctgccccagcacctcaccctgcgggcccagaacgccctggacaacctcgtgatgctgcacaactccgagcagggcgggaaggcgtaccgccacgccatggaggagctgcccgacaccatcgagaccctcatgctgctggccctcatcgccgtcctgaccggcggggtgatgctgttcttcctcagcggcaagggcctggggaagacgtccatcggcctgctctgcgtgatggcgagctccgccctgctgtggatggccagcgtcgagccccactggatcgccgcctccatcatcctcgagttcttcctgatggtgctgctcatcccggagcccgaccggcagcgcacgccccaggacaaccagctggcgtacgtggtcatcgggctcctgttcatgatcctgaccgtggccgccaacgagatgggcctgctcgagaccacgaagaaggacctggggatcggccacgtggccgccgagaaccaccaccacgtcaccatgctggacgtggacctccggccggcgagcgcctggaccctgtacgccgtggccaccacggtcatcacccccatgatgcgccacaccatcgagaacaccacggccaacatctccctgaccgcgatcgccaaccaggccgccatcctcatgggcctggacaaggggtggcccatcagcaagatggacatcggcgtgcccctgctcgccctggggtgctactcccaggtgaacccgctgaccctcaccgcggccgtcctgatgctggtggcccactacgccatcatcggccccgggctccaggcgaaggccacgcgggaggcccagaagcgcaccgccgccggcatcatgaagaaccccaccgtggacggcatcgtcgcgatcgacctggaccccgtggtgtacgacgccaagttcgagaagcagctggggcagatcatgctcctgatcctgtgcaccagccagatcctcctgatgcgcacgacctgggccctgtgcgagtccatcaccctcgccaccggcccgctgacgaccctgtgggaggggagccccggcaagttctggaacaccaccatcgccgtctccatggcgaacatcttccggggcagctacctcgccggggccggcctggccttctccctgatgaagtccctcgggggcgggcgccggggcacgggcgcccagggggagaccctgggcgagaagtggaagcgccagctgaaccagctctccaagagcgagttcaacacctacaagcggagcgggatcatggaggtggaccgctccgaggcgaaggagggcctgaagcgcggggagaccacgaagcacgccgtgagccgcggcaccgccaagctgcggtggttcgtcgagcgcaacctggtgaagcccgagggcaaggtgatcgacctcgggtgcggccgcgggggctggtcctactactgcgccgggctgaagaaggtcaccgaggtgaagggctacaccaagggcgggcccggccacgaggagccgatccccatggcgacgtacgggtggaacctggtgaagctccacagcggcaaggacgtcttcttcacgccgcccgagaagtgcgacaccctgctgtgcgacatcggggagtccagcccgaaccccaccatcgaggagggccgcaccctccgggtgctgaagatggtggagccctggctgcgcggcaaccagttctgcatcaagatcctcaacccctacatgccgtccgtcgtggagacgctggagcagatgcagcggcgccacgggggcatgctggtgcggaaccccctcagccgcaactccacccacgagatgtactgggtcagctgcgggaccggcaacatcgtgtccgccgtgaacatgaccagccggatgctgctgaaccgcttcacgatggcccaccgcaagcccacctacgagcgggacgtcgacctcggcgccgggacccgccacgtggccgtggagcccgaggtcgcgaacctgggcatcatcgggcagcggatcgagaacatcaagaacgagcacaagtccacctggcactacgacgaggacaacccgtacaagacgtgggcctaccacggcagctacgaggtgaagccctccgggagcgcctccagcatggtcaacggcgtggtgcgcctgctcaccaagccctgggacgtcatccccatggtgacccagatcgccatgaccgacacgaccccgttcggccagcagcgggtgttcaaggagaaggtcgacacccgcacgccccgggccaagcgcgggacggcgcagatcatggaggtgaccgccaagtggctgtgggacttcctgtcccggaacaagaagccccgcatctgcacccgggaggagttcatccgcaaggtgcggagcaacgccgccatcggcgccgtcttcgtggacgagaaccagtggaacagcgcgaaggaggccgtggaggacgagcgcttctgggacctcgtccaccgggagcgcgagctgcacaagcaggggaagtgcgcgacctgcgtgtacaacatgatgggcaagcgggagaagaagctgggggagttcggcaaggccaagggctcccgcgcgatctggtacatgtggctcggggcccggttcctggagttcgaggccctgggcttcatgaacgaggaccactggttcagccgcgagaactccctcagcggggtggagggcgaggggctgcacaagctgggctacatcctccgggacatctccaagatcccgggcgggaacatgtacgccgacgacacggccggctgggacacccgcatcaccgaggacgacctgcagaacgaggcgaagatcaccgacatcatggagcccgagcacgccctgctcgccacgagcatcttcaagctgacctaccagaacaaggtcgtgcgcgtgcagcggcccgccaagaacgggaccgtcatggacgtgatctcccgccgggaccagcgcggcagcggccaggtggggacctacggcctgaacacgttcaccaacatggaggtccagctcatccggcagatggagtccgaggggatcttcctgcccagcgagctggagaccaccaacctcgccgagcgcgtgctggactggctggagaagcacggcgtggagcggctcaagcgcatggcgatctccggggacgactgcgtcgtgaagccgatcgacgaccggttcgccacggccctgatcgccctgaacgacatgggcaaggtgcgcaaggacatcccccagtgggagcccagcaagggctggaacgactggcagcaggtccccttctgctcccaccacttccaccagctcatcatgaaggacgggcgggagatcgtggtgccgtgccgcaaccaggacgagctggtcggccgggcccgcgtgagccagggggcgggctggtccctgcgggagaccgcctgcctcggcaagagctacgcccagatgtggcagctgatgtacttccaccgccgggacctgcgcctcgccgccaacgcgatctgctccgccgtgcccgtcgactgggtgcccaccagccggaccacgtggagcatccacgcccaccaccagtggatgaccaccgaggacatgctgtccgtgtggaaccgcgtctggatcgaggagaacccctggatggaggacaagacccacgtgagctcctgggaggaggtgccgtacctgggcaagcgcgaggaccagtggtgcggcagcctcatcgggctgaccgcccgggcgacgtgggccaccaacatccaggtcgccatcaaccaggtgcgccggctgatcggcaacgagaactacctcgactacatgacctccatgaagcgcttcaagaacgagagcgaccccgagggggccctgtggtga

SEQ ID NO: 8209 - RNA, 9879 nt, synthetic construct
  misc_feature 1..9879: note = derived and/or modified CDS sequence (opt1) from DENV-1__FJ205875__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccgggatcaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtcgccctggcgccccacgtgggcctggggctcgagacccgcaccgagacctggatgagcagcgagggcgcctggaagcagatccagaaggtggagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtgggcatcggcaaccgggacttcgtcgaggggctgagcggcgccacgtgggtggacgtggtcctggagcacgggtcctgcgtgaccaccatggccaaggacaagcccaccctcgacatcgagctgctgaagacggaggtgaccaaccccgcgatcctccgcaagctgtgcatcgaggccaagatcagcaacaccaccacggactcccggtgcccgacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgcgaagaagcaggaggtggtggtcctgggctcccaggagggcgccatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtggcggagacccagcacggcacggtcctggtccaggtgaagtacgagggcaccgacgccccctgcaagatccccttctccacccaggacgagaagggggtcacccagaacggccgcctcatcacggccaacccgatcgtgaccgacaaggagaagcccgtgaacatcgagaccgagccgcccttcggggagagctacatcgtcgtgggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtgttcacctccgtcgggaagctggtgcaccaggtgttcggcaccgcctacggggtcctgttcagcggcgtgtcctggaccatgaagatcgggatcggcatcctcctgacgtggctgggcctcaacagccgctccaccagcctgtccatgacctgcatcgccgtggggatggtcaccctgtacctcggcgtgatggtgcaggccgacagcgggtgcgtcatcaactggaagggccgcgagctgaagtgcgggtccggcatcttcgtgacgaacgaggtgcacacctggaccgagcagtacaagttccaggccgacagcccgaagcggctgagcgcggccatcggcaaggcctgggaggagggggtctgcggcatccgctccgccacccggctcgagaacatcatgtggaagcagatcagcaacgagctgaaccacatcctgctcgagaacgacatgaagttcaccgtggtggtcggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacgaccagcgggcctggaacatctgggaggtggaggactacggcttcgggatcttcaccacgaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtcaagacctgcatctggcccaagagccacacgctctggtccaacggcgtgctggagagcgagatgatcatccccaagatctacgggggcccgatctcccagcacaactaccggcccgggtacttcacccagaccgccggcccctggcacctggggaagctcgagctggacttcgacctgtgcgagggcaccacggtggtcgtggacgagcactgcggcaaccgcgggccgagcctccggaccaccaccgtgacgggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggatcctgtgcgtgagcatcatgatcgaggaggtgatgcggtcccgctggagcaagaagatgctcatgaccggcaccctggccgtcttcctgctcctgatcatggggcagctgacgtggaacgacctcatccggctgtgcatcatggtgggcgccaacgcgtccgaccgcatggggatgggcaccacctacctggccctcatggccaccttcaagatgcgcccgatgttcgccgtggggctgctgttccggcgcctcacgagccgggaggtcctgctgctcaccatcgggctgtccctggtggccagcgtggagctccccaactccctggaggagctgggcgacgggctcgcgatgggcatcatgatgctgaagctgctcaccgagttccagccccaccagctgtggaccacgctgctcagcctgaccttcatcaagaccaccctgtccctcgactacgcctggcgcacgatggccatggtcctgagcatcgtgtccctgttccccctctgcctgagcaccacctcccagaagaccacgtggctgccggtcctcctgggcagcttcgggtgcaagcccctgaccatgttcctcatcaccgagaacaagatctggggccggaagtcctggcccctgaacgaggggatcatggccatcggcatcgtgagcatcctgctctccagcctgctgaagaacgacgtgcccctcgcggggccgctgatcgccggcggcatgctgatcgcctgctacgtcatcagcgggtccagcgccgacctctccctggagaaggccgcggaggtgagctgggaggaggaggccgagcactccggcaccagccacaacatcctggtggaggtccaggacgacgggaccatgaagatcaaggacgaggagcgcgacgacacgctcaccatcctgctgaaggccaccctcctggccgtgtccggcgtgtaccccatgagcatccccgccaccctgttcgtctggtacttctggcagaagaagaagcagcggtccggggtgctctgggacacgcccagcccgcccgaggtggagcgcgcggtcctggacgacggcatctaccggatcctgcagcgcggcctgctcgggcggtcccaggtgggcgtgggggtcttccaggacggcgtgttccacaccatgtggcacgtgacccgcggggccgtcctgatgtaccagggcaagcggctggagcccagctgggcctccgtgaagaaggacctcatcagctacggcgggggctggcgcttccaggggtcctggagcaccggcgaggaggtgcaggtcatcgccgtggagcccgggaagaacccgaagaacgtgcagacgacccccggcaccttcaagacccccgagggcgaggtcggggccatcgcgctggacttcaagcccggcacgtccgggagcccgatcgtgaaccgggagggcaagatcgtgggcctgtacgggaacggcgtcgtgaccacctccgggacctacgtgagcgccatcgcccaggccaagacgagccaggagggccccctccccgagatcgaggacgaggtcttcaagaagcgcaacctgaccatcatggacctgcacccggggtccggcaagacccggcgctacctccccgccatcgtgcgggaggcgatcaagcgcaagctgcggaccctgatcctcgcccccacgcgcgtggtcgccagcgagatggccgaggcgctgaagggcatgcccatccgctaccagaccaccgccgtgaagtccgagcacaccgggcgggagatcgtggacctgatgtgccacgccacgttcaccatgcgcctcctgagcccggtccgggtgcccaactacaacatgatcatcatggacgaggcccacttcaccgaccccgcctccatcgcggcccgcggctacatcagcacccgggtggggatgggcgaggccgccgccatcttcatgacggcgacgccgcccgggtccgtcgaggccttcccccagagcaacgccgtgatccaggacgaggagcgcgacatccccgagcggtcctggaacagcggctacgactggatcaccgacttccccggcaagaccgtgtggttcgtcccctccatcaagagcgggaacgacatcgccaactgcctgcgcaagaacggcaagcgggtgatccagctctcccgcaagacgttcgacaccgagtaccagaagaccaagaacaacgactgggactacgtggtcaccacggacatcagcgagatgggggccaacttccgggcggaccgcgtgatcgacccccggcgctgcctgaagcccgtgatcctgaaggacggccccgagcgggtcatcctcgccgggccgatgcccgtgaccgtggcctccgccgcgcagcgccggggccgcatcggccggaaccagaacaaggagggggaccagtacgtctacatgggccagcccctgaacaacgacgaggaccacgcccactggaccgaggccaagatgctgctcgacaacatcaacacccccgaggggatcatcccggccctgttcgagcccgagcgcgagaagtccgccgcgatcgacggcgagtaccgcctgcgcggggaggcccgcaagacgttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcccggacctacagcgacccgctcgccctgcgcgagttcaaggagttcgcggccgggcggcgcagcgtgtccggcgacctgatcctcgagatcggcaagctgccccagcacctgaccctccgggcccagaacgccctggacaacctggtgatgctccacaacagcgagcagggcgggaaggcctaccgccacgcgatggaggagctgcccgacaccatcgagacgctgatgctcctggccctgatcgccgtcctcaccgggggcgtgaccctgttcttcctgtccgggaagggcctcggcaagaccagcatcgggctgctgtgcgtgatggcctccagcgcgctcctgtggatggccaacgtcgagccccactggatcgccgcctccatcatcctggagttcttcctcatggtgctgctgatcccggagcccgaccggcagcgcacgccccaggacaaccagctcgcctacgtggtcatcggcctgctgttcatgatcctcaccgtggcggccaacgagatggggctgctggagaccaccaagaaggacctcggcatcgggcacgtggccgccgagaaccaccaccacgccacgatgctggacgtcgacctgcggccggcgagcgcctggaccctctacgccgtggccaccaccgtgatcacgcccatgatgcgccacaccatcgagaacaccaccgccaacatctccctgacggcgatcgccaaccaggccgccatcctgatgggcctcgacaagggctggcccatcagcaagatggacatcggggtccccctgctggccctcggctgctactcccaggtgaacccgctgaccctgaccgcggccgtgctcatgctggtcgcccactacgccatcatcgggcccggcctgcaggcgaaggccacccgggaggcccagaagcgcacggccgccgggatcatgaagaaccccaccgtggacggcatcgtggcgatcgacctcgaccccgtcgtgtacgacgccaagttcgagaagcagctgggccagatcatgctgctcatcctgtgcaccagccagatcctgctcatgcgcaccacgtgggccctgtgcgagtccatcaccctggccaccgggccgctcaccacgctgtgggagggcagccccgggaagttctggaacaccaccatcgccgtgtccatggcgaacatcttccggggcagctacctggccggcgccgggctcgccttctccctgatgaagtccctgggcgggggccgccgggggaccggcgcccagggcgagacgctcggggagaagtggaagcgccagctgaaccagctgtccaagagcgagttcaacacctacaagcggagcggcatcatggaggtcgaccgctccgaggcgaaggaggggctcaagcggggcgagaccaccaagcacgccgtgagccgcgggacggccaagctgcggtggctggtggagcgcaacctggtcaagcccgagggcaaggtgatcgacctcggctgcgggcggggcgggtggtcctactactgcgccggcctgaagaaggtgaccgaggtcaaggggtacaccaagggcggccccgggcacgaggagccgatccccatggcgacctacggctggaacctggtgaagctctacagcgggaaggacgtgttcttcacgccgcccgagaagtgcgacacgctgctgtgcgacatcggcgagtccagcccgaaccccaccatcgaggaggggcgcaccctccgggtcctgaagatggtggagccctggctgcgcggcaaccagttctgcatcaagatcctcaacccctacatgccgtccgtggtcgagaccctggagcagatgcagcggaagcacggcgggatgctggtgcgcaaccccctcagccggaactccacgcacgagatgtactgggtgagctgcggcaccgggaacatcgtctccgccgtgaacatgaccagccgcatgctgctgaaccggttcaccatggtgcaccgcaagcccacgtacgagcgcgacgtcgacctcggcgccggcacccggcacgtggccgtggagcccgaggtcgccaacctggacatcatcgggcagcgcatcgagaacatcaagaacgagcacaagtccacctggcactacgacgaggacaacccgtacaagacctgggcgtaccacggcagctacgaggtgaagccctccgggagcgcctccagcatggtgaacggcgtcgtgcggctgctcacgaagccctgggacgtcatccccatggtgacccagatcgccatgaccgacaccacgccgttcgggcagcagcgcgtgttcaaggagaaggtcgacacccggacgccccgggccaagcggggcaccgcccagatcatggaggtgacggcgaagtggctgtggggcttcctgtcccgcaacaagaagccccggatctgcacccgcgaggagttcacccggaaggtgcgcagcaacgccgccatcggggccgtcttcgtggacgagaaccagtggaacagcgccaaggaggcggtggaggacgagcggttctgggacctcgtccaccgcgagcgggagctgcacaagcagggcaagtgcgcgacctgcgtgtacaacatgatggggaagcgcgagaagaagctgggcgagttcgggaaggccaagggctcccgggccatctggtacatgtggctcggcgcgcgcttcctggagttcgaggccctggggttcatgaacgaggaccactggttcagccgggagaactccttcagcggcgtggagggggacggcctccacaagctggggtacatcctgcgcgacatctccaagatcccgggcggcaacatgtacgccgacgacacggccgggtgggacacccggatcaccgaggacgacctccagaacgaggccaagatcaccgacatcatggagcccgagcacgcgctgctggccacgagcatcttcaagctcacctaccagaacaaggtcgtgcgcgtgcagcgccccgccaagaacggcaccgtcatggacgtgatctcccggcgcgaccagcgggggagcggccaggtgggcacctacgggctgaacacgttcaccaacatggaggcccagctgatccgccagatggagtccgagggcatcttcctccccagcgagctggagaccccgaacctggccgagcgggtcctcgactggctggagaagcacgggaccgagcgcctgaagcggatggcgatctccggcgacgactgcgtggtgaagcccgtcgacgaccgcttcgccacggccctcaccgccctgaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctcgtggggcgcgcccgggtcagccagggcgcggggtggtccctgcgcgagaccgcctgcctgggcaagagctacgcccagatgtggcagctcatgtacttccaccggcgcgacctgcggctggccgccaacgcgatctgctccgccgtgcccgtggactgggtccccaccagccgcaccacgtggagcatccacgcccaccaccagtggatgaccaccgaggacatgctctccgtgtggaaccgggtgtggatcgaggagaacccgtggatggaggacaagacccacgtcagctcctgggaggaggtgccctacctggggaagcgcgaggaccagtggtgcggcagcctgatcggcctcacggcccgcgcgacctgggccaccaacatccaggtggccatcaaccaggtccggcgcctgatcgggaacgagaactacctggactacatgacctccatgaagcggttcaagaacgagagcgaccccgagggcgccctctggtga

SEQ ID NO: 8210 - RNA, 9879 nt, synthetic construct
  misc_feature 1..9879: note = derived and/or modified CDS sequence (opt1) from DENV-1__FJ410173__SS-prME
  source 1..9879: mol_type = other RNA
agcgtgaccatgctgctcatgctgctgcccaccgccctcgccttccacctgaccacccggggcggggagccccacatgatcgtcagcaagcaggagcggggcaagagcctcctgttcaagaccagcgccgggatcaacatgtgcaccctgatcgccatggacctgggcgagctctgcgaggacaccatgacctacaagtgcccccggatcaccgaggccgagcccgacgacgtggactgctggtgcaacgccaccgacacgtgggtgacctacgggacctgcagccagaccggcgagcaccggcgggacaagcggtccgtcgccctggcgccccacgtgggcctggggctcgagacgcgcaccgagacctggatgagcagcgagggcgcctggaagcagatccagaaggtggagacctgggccctgcggcaccccgggttcacggtcaccgccctgttcctcgcgcacgccatcggcaccagcatcacccagaaggggatcatcttcatcctgctgatgctcgtgacgccctccatggccatgcgctgcgtgggcatcggcaaccgggacttcgtcgaggggctgagcggcgccacctgggtggacgtggtcctggagcacgggtcctgcgtgaccaccatggccaaggacaagcccacgctcgacatcgagctgctgaagaccgaggtgaccaaccccgcggtcctccgcaagctgtgcatcgaggccaagatcagcaacaccacgaccgactcccggtgccccacccagggcgaggccaccctggtggaggagcaggacagcaacttcgtgtgccgccggacgttcgtcgaccgcggctgggggaacggctgcggcctcttcggcaaggggtccctgctgacctgcgccaagttcaagtgcgtgaccaagctcgagggcaagatcgtgcagtacgagaacctgaagtacagcgtcatcgtgaccgtgcacacgggcgaccagcaccaggtcgggaacgagaccaccgagcacggcaccatcgccaccatcacgccccaggcgcccaccaccgagatccagctgaccgactacggggccctcacgctggactgcagcccccggaccggcctggacttcaacgagatggtgctcctgaccatgaaggagaagtcctggctggtccacaagcagtggttcctcgacctgccgctgccctggacctccggggccagcacgagccaggagacctggaaccgccaggacctcctggtgaccttcaagaccgcccacgccaagaagcaggaggtggtcgtgctgggctcccaggagggcgcgatgcacacggccctcaccggggccaccgagatccagaccagcggcacgaccaccatcttcgccgggcacctgaagtgccggctgaagatggacaagctcaccctgaagggcatgtcctacgtgatgtgcacggggagcttcaagctggagaaggaggtcgccgagacccagcacggcaccgtgctggtgcaggtcaagtacgagggcaccgacgcgccctgcaagatccccttctccgcccaggacgagaagggggtgacgcagaacggccgcctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtcttcacctccgtggggaagctggtgcaccaggtcttcggcgccgcctacggggtgctgttcagcggcgtgtcctggaccatgaagatcgggatcggcatcctcctgacgtggctgggcctcaacagccgctccaccagcctgtccatgacctgcatcgccgtcgggatggtgaccctgtacctcggcgtgatggtccaggccgacagcgggtgcgtgatcaactggaagggccgcgagctgaagtgcgggtccggcatcttcgtgacgaacgaggtccacacctggaccgagcagtacaagttccaggcggacagcccgaagcggctgagcgccgccatcggcaaggcctgggaggagggggtgtgcggcatccgctccgccacccggctcgagaacatcatgtggaagcagatcagcaacgagctgaaccacatcctgctcgagaacgacatgaagttcaccgtggtcgtgggggacgcgaacggcatcctggcccaggggaagaagatgatccgcccccagcccatggagcaccggtactcctggaagtcctggggcaaggccaagatcatcggcgccgacatccagaactccacgttcatcatcgacgggcccgacaccccggagtgccccgacgaccagcgcgcgtggaacatctgggaggtggaggactacggcttcgggatcttcaccaccaacatctggctgaagctccgggacagctacacgcagatgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacaccctctggagcaacggcgtgctggagtccgagatgatcatccccaagatctacgggggcccgatcagccagcacaactaccgccccgggtacttcacgcagaccgccggcccctggcacctggggaagctcgagctggacttcgacctgtgcgagggcaccaccgtcgtggtggacgagcactgcggcaaccgggggccgtccctccgcacgaccaccgtcaccggcaagatcatccacgagtggtgctgccggagctgcacgctgccgcccctgcgcttccgcggggaggacggctgctggtacgggatggagatccgccccgtgaaggagaaggaggagaacctcgtgcggtccatggtcagcgccggcagcggcgaggtggactccttcagcctggggatcctgtgcgtgtccatcatgatcgaggaggtcatgcgcagccggtggtcccgcaagatgctcatgaccggcaccctggccgtgttcctgctcctgatcatggggcagctgacctggaacgacctcatccgcctgtgcatcatggtgggcgcgaacgccagcgaccggatggggatgggcacgacctacctggccctcatggccaccttcaagatgcgcccgatgttcgccgtcggcctgctgttccggcgcctcacctcccgggaggtgctgctgctcacgatcgggctgagcctggtggcgtccgtcgagctccccaacagcctggaggagctgggcgacgggctcgccatgggcatcatgatgctgaagctgctcaccgagttccagccccaccagctgtggaccaccctgctctccctgacgttcatcaagaccaccctgagcctcgactacgcctggcgcaccatggccatggtgctgtccatcgtcagcctgttccccctctgcctgtccacgaccagccagaagaccacctggctgccggtgctcctgggctccttcgggtgcaagcccctgacgatgttcctcatcaccgagaacaagatctggggccgcaagagctggcccctgaacgaggggatcatggcgatcggcatcgtgtccatcctgctcagcagcctgctgaagaacgacgtccccctcgccgggccgctgatcgccggcggcatgctgatcgcctgctacgtgatctccgggagctccgccgacctcagcctggagaaggcggccgaggtgtcctgggaggaggaggccgagcacagcggcacctcccacaacatcctggtcgaggtgcaggacgacgggaccatgaagatcaaggacgaggagcgcgacgacaccctcacgatcctgctgaaggccaccctcctggccgtgagcggcgtctaccccatgtccatccccgcgaccttcttcgtgtggtacttctggcagaagaagaagcagcggagcggggtgctgtgggacaccccctccccgcccgaggtcgagcgcgccgtgctcgacgacggcatctaccggatcctgcagcgcggcctgctggggcggagccaggtgggcgtcggggtgttccaggacggcgtgttccacacgatgtggcacgtcacccgcggggccgtgctcatgtaccagggcaagcggctggagccctcctgggccagcgtgaagaaggacctgatctcctacggcgggggctggcgcttccaggggagctggaacaccggcgaggaggtccaggtgatcgccgtggagcccgggaagaacccgaagaacgtccagaccacgcccggcaccttcaagacccccgagggcgaggtgggggcgatcgccctcgacttcaagcccggcacctccgggagcccgatcgtgaaccgggagggcaagatcgtcggcctgtacgggaacggcgtggtgacgacctccgggacctacgtcagcgccatcgcccaggccaagaccagccaggagggccccctgcccgagatcgaggaggaggtgttcaagaagcgcaacctcacgatcatggacctgcacccggggtccggcaagacccggcgctacctgcccgcgatcgtgcgggaggccatcaagcgcaagctccgcaccctgatcctggcccccacccgggtcgtggccagcgagatggcggaggccctcaagggcatgcccatccgctaccagacgaccgccgtgaagtccgagcacaccgggcgggagatcgtcgacctgatgtgccacgccaccttcacgatgcgcctgctcagcccggtgcgggtgcccaactacaacatgatcatcatggacgaggcccacttcaccgaccccgcgtccatcgccgcccgcggctacatcagcacccgggtcgggatgggcgaggccgccgcgatcttcatgaccgccacgcccccggggtccgtggaggccttcccccagagcaacgccgtgatccaggacgaggagcgcgacatccccgagcggtcctggaacagcggctacgactggatcaccgacttccccggcaagaccgtctggttcgtgccgtccatcaagagcgggaacgacatcgccaactgcctgcgcaagaacggcaagcgggtgatccagctgtcccgcaagaccttcgacacggagtaccagaagacccggaacaacgactgggactacgtcgtgaccaccgacatcagcgagatgggggcgaacttccgcgccgaccgggtgatcgacccccgccggtgcctcaagcccgtcatcctgaaggacggccccgagcgcgtgatcctggccgggccgatgcccgtgacggtcgcctccgcggcccagcggcgcggccgcatcggccggaaccagaacaaggagggggaccagtacgtgtacatgggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgcgcggggaggcccggaagaccttcgtcgagctgatgcgccggggcgacctccccgtgtggctgtcctacaaggtggccagcgagggcttccagtactccgaccgccggtggtgcttcgacggggagcgcaacaaccaggtcctggaggagaacatggacgtggagatctggacgaaggagggcgagcggaagaagctccgcccccggtggctggacgcccgcacctacagcgacccgctggcgctccgggagttcaaggagttcgccgccgggcgccggagcgtgtccggcgacctgatcctggagatcggcaagctcccccagcacctgaccctgcgcgcccagaacgccctcgacaacctggtcatgctgcacaacagcgagcagggcgggaaggcgtaccggcacgccatggaggagctccccgacaccatcgagaccctgatgctgctcgccctgatcgccgtgctgaccggcggggtgaccctcttcttcctgtccgggaaggggctgggcaagaccagcatcgggctcctgtgcgtcatggcgtccagcgccctgctctggatggccaacgtggagccccactggatcgccgcctccatcatcctggagttcttcctgatggtgctcctgatcccggagcccgaccgccagcggacgccccaggacaaccagctggcgtacgtcgtgatcggcctcctgttcatgatcctgacggtggccgccaacgagatggggctcctggagaccaccaagaaggacctgggcatcgggcacgtcgccgccgagaaccagcaccacgcgaccatgctcgacgtggacctgcgcccggccagcgcctggacgctgtacgccgtggccaccaccgtcatcacccccatgatgcgccacacgatcgagaacaccaccgcgaacatctccctcaccgccatcgccaaccaggccgccatcctgatgggcctggacaagggctggcccatcagcaagatggacatcggggtgcccctcctggcgctgggctgctactcccaggtgaacccgctcacgctgaccgccgccgtcctgatgctcgtggcccactacgcgatcatcgggcccggcctgcaggccaaggccacccgggaggcccagaagcgcaccgccgcggggatcatgaagaaccccacggtggacggcatcgtcgccatcgacctggaccccgtggtgtacgacgccaagttcgagaagcagctcggccagatcatgctgctgatcctctgcaccagccagatcctgctgatgcggaccacctgggccctctgcgagtccatcacgctggccaccgggccgctgaccaccctctgggagggcagccccgggaagttctggaacacgaccatcgcggtctccatggccaacatcttccgcggcagctacctggccggcgccgggctggccttctccctcatgaagtccctgggcgggggccggcgcgggaccggcgcgcagggcgagaccctgggggagaagtggaagcggcagctcaaccagctgtccaagagcgagttcaacacgtacaagcgcagcggcatcatggaggtggaccggtccgaggccaaggaggggctgaagcgcggcgagaccaccaagcacgccgtgagccgggggaccgccaagctccgctggttcgtcgagcggaacctggtgaagcccgagggcaaggtgatcgacctgggctgcgggcgcggcgggtggtcctactactgcgcgggcctgaagaaggtcacggaggtgaaggggtacaccaagggcggccccgggcacgaggagccgatccccatggccacctacggctggaacctcgtgaagctgtacagcgggaaggacgtcttcttcacgccgcccgagaagtgcgacaccctgctctgcgacatcggcgagtccagcccgaaccccacgatcgaggaggggcggaccctgcgcgtgctgaagatggtggagccctggctccggggcaaccagttctgcatcaagatcctgaacccctacatgccgtccgtcgtggagaccctggagcagatgcagcgcaagcacggcgggatgctcgtgcggaaccccctgagccgcaactccacccacgagatgtactgggtcagctgcggcacggggaacatcgtgtccgccgtgaacatgaccagccgcatgctgctcaaccggttcaccatgacccaccgcaagcccacgtacgagcgggacgtcgacctgggcgccggcacccgccacgtggccgtggagcccgaggtcgcgaacctggacatcatcgggcagcggatcgagaacatcaagaacgagcacaagtccacctggcactacgacgaggacaacccgtacaagacctgggcctaccacggcagctacgaggtgaagccctccgggagcgcctccagcatggtgaacggcgtcgtgcgcctcctgacgaagccctgggacgtcatccccatggtgacccagatcgccatgaccgacaccacgccgttcgggcagcagcgggtgttcaaggagaaggtcgacacccgcacgccccgggccaagcgcggcaccgcgcagatcatggaggtgacggccaagtggctgtggggcttcctctcccggaacaagaagccccgcatctgcacccgggaggagttcacccgcaaggtgcggagcaacgccgccatcggggccgtcttcgtggacgagaaccagtggaacagcgcgaaggaggccgtggaggacgagcgcttctgggacctggtccaccgggagcgcgagctgcacaagcagggcaagtgcgcgacctgcgtgtacaacatgatggggaagcgggagaagaagctcggcgagttcgggaaggccaagggctcccgcgcgatctggtacatgtggctgggcgcccggttcctggagttcgaggccctcgggttcatgaacgaggaccactggttcagccgcgagaactccttcagcggcgtggagggggagggcctgcacaagctggggtacatcctccgcgacatctccaagatcccgggcggcaacatgtacgccgacgacacggccgggtgggacacccggatcaccgaggacgacctgcagaacgaggcgaagatcaccgacatcatggagcccgagcacgccctgctcgccacgagcatcttcaagctgacctaccagaacaaggtcgtgcgcgtgcagcggcccgccaagaacggcaccgtcatggacgtgatctcccgccgggaccagcgcgggagcggccaggtgggcacctacgggctgaacacgttcaccaacatggaggtccagctcatccggcagatggagtccgagggcatcttcctgcccagcgagctggagaccccgaacctcgccgagcgcgtgctgaactggctggagaagcacgggaccgagcggctcaagcgcatggcgatctccggcgacgactgcgtggtcaagcccgtggacgaccggttcgccacggccctgatcgccctgaacgacatggggaaggtgcgcaaggacatcccccagtgggagcccagcaagggctggaacgactggcagcaggtcccgttctgctcccaccacttccaccagctcatcatgaaggacggccgggagatcgtggtgccctgccgcaaccaggacgagctggtcgggcgggcccgcgtgagccagggcgcggggtggtccctgcgggagaccgcctgcctcggcaagagctacgcccagatgtggcagctgatgtacttccaccgccgggacctgcgcctcgccgccaacgcgatctgctccgccgtgcccgtcgactgggtgcccaccagccgcaccacctggagcatccacgcccaccaccagtggatgacgaccgaggacatgctgtccgtgtggaaccgggtctggatcgaggagaacccgtggatggaggacaagacccacgtgagctcctgggaggaggtgccctacctggggaagcgcgaggaccagtggtgcggcagcctcatcggcctgaccgcccgggcgacgtgggccaccaacatccaggtcgccatcaaccaggtgcgccggctgatcgggaacgagaactacctcgactacatgacctccatgaagcgcttcaagaacgagagcgaccccgagggcgccctgtggtga

SEQ ID NO: 8211 - RNA, 9879 nt, synthetic construct
  misc_feature 1..9879: note = derived and/or modified CDS sequence (opt1) from DENV-1__FJ410174__SS-prME
  source 1..9879: mol_type = other RNA
agcgtgaccatgctgctcatgctgctgcccaccgccctcgccttccacctgaccacccggggcggggagccccacatgatcgtcagcaagcaggagcggggcaagagcctgctgttcaagaccagcgccgggatcaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgggacaagcggtccgtcgccctggcgccccacgtgggcctggggctcgagacccggaccgagacctggatgagctccgagggcgcctggaagcagatccagaaggtggagacctgggccctgcggcacccggggttcacggtcaccgccctgttcctcgcgcacgccatcggcaccagcatcacccagaaggggatcatcttcatcctgctgatgctcgtgacgccctccatggccatgcggtgcgtgggcatcggcaaccgggacttcgtcgaggggctgagcggcgccacctgggtggacgtggtcctggagcacgggtcctgcgtgaccaccatcgccaaggacaagcccacgctcgacatcgagctgctgaagaccgaggtgaccaaccccgcggtcctccgcaagctgtgcatcgaggccaagatcagcaacaccacgaccgactcccggtgcccgacccagggcgaggccaccctggtggaggagcaggacagcaacttcgtgtgccgccggacgttcgtcgaccgcggctgggggaacggctgcggcctcttcggcaaggggtccctgctgacctgcgccaagttcaagtgcgtgaccaagctcgagggcaagatcgtgcagtacgagaacctgaagtacagcgtcatcgtgaccgtgcacacgggcgaccagcaccaggtcgggaacgagaccaccgagcacggcaccatcgccaccatcacgccccaggcgcccacctccgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggaccagcggggccagcacctcccaggagacgtggaaccgccaggacctcctggtgaccttcaagaccgcccacgccaagaagcaggaggtggtcgtgctgggcagccaggagggcgcgatgcacaccgccctcacgggggccaccgagatccagacctccggcaccacgaccatcttcgccgggcacctgaagtgccggctgaagatggacaagctcaccctgaagggcatgagctacgtgatgtgcaccgggtccttcaagctggagaaggaggtcgccgagacgcagcacggcaccgtgctggtgcaggtcaagtacgagggcaccgacgcgccctgcaagatccccttcagcgcccaggacgagaagggggtgacccagaacggccgcctcatcacggccaacccgatcgtgaccgacaaggagaagcccgtcaacatcgagaccgagccgcccttcggggagtcctacatcgtggtgggcgccggcgagaaggcgctgaagctgagctggttcaagaaggggtccagcatcggcaagatgttcgaggccaccgcccgcggggcccgccggatggccatcctcggcgacacggcgtgggacttcgggtccatcggcggcgtcttcaccagcgtggggaagctggtgcaccaggtcttcggcgccgcctacggggtgctgttctccggcgtgagctggaccatgaagatcgggatcggcatcctcctgacctggctgggcctcaactcccgcagcacgtccctgagcatgacctgcatcgccgtcgggatggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggcggacagcccgaagcggctgtccgccgccatcggcaaggcctgggaggagggggtgtgcggcatccgcagcgccacccggctcgagaacatcatgtggaagcagatctccaacgagctgaaccacatcctgctcgagaacgacatgaagttcaccgtggtcgtgggggacgcgaacggcatcctggcccaggggaagaagatgatccgcccccagcccatggagcaccggtacagctggaagtcctggggcaaggccaagatcatcggcgccgacatccagaacaccacgttcatcatcgacgggcccgacaccccggagtgccccgacgaccagcgcgcgtggaacatctgggaggtggaggactacggcttcgggatcttcaccaccaacatctggctgaagctccgggacagctacacgcagatgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacaccctctggagcaacggcgtgctggagtccgagatgatcatccccaagatctacgggggcccgatcagccagcacaactaccgccccgggtacttcacgcagaccgccggcccctggcacctggggaagctcgagctggacttcgacctgtgcgagggcaccaccgtcgtggtggacgagcactgcggcaaccgggggccgtccctccgcacgaccaccgtcaccggcaagatcatccacgagtggtgctgccggagctgcacgctgccgcccctgcgcttccgcggggaggacggctgctggtacgggatggagatccgccccgtgaaggagaaggaggagaacctcgtgcggtccatggtcagcgccggcagcggcgaggtggactccttcagcctggggatcctgtgcgtgtccatcatgatcgaggaggtcatgcgcagccggtggtcccgcaagatgctcatgaccggcaccctggccgtgttcctgctcctgatcatggggcagctgacctggaacgacctcatccgcctgtgcatcatggtgggcgcgaacgccagcgaccggatggggatgggcatcacgtacctggccctcatggccaccttcaagatgcgcccgatgttcgccgtcggcctgctgttccggcgcctcacctcccgggaggtgctgctgctcaccatcgggctgagcctggtggcgtccgtcgagctccccaacagcctggaggagctgggcgacgggctcgccatgggcatcatgatgctgaagctgctcacggagttccagccccaccagctgtggaccaccctgctctccctgaccttcatcaagacgaccctgagcctcgactacgcctggcgcaccatggccatggtgctgtccatcgtcagcctgttccccctctgcctgtccaccacgagccagaagaccacctggctgccggtgctcctgggctccttcgggtgcaagcccctgaccatgttcctcatcacggagaacaagatctggggccgcaagagctggcccctgaacgaggggatcatggcgatcggcatcgtgtccatcctgctcagcagcctgctgaagaacgacgtccccctcgccgggccgctgatcgccggcggcatgctgatcgcctgctacgtgatctccgggagctccgccgacctcagcctggagaaggcggccgaggtgtcctgggaggaggaggccgagcacagcggcacctcccacaacatcctggtcgaggtgcaggacgacgggaccatgaagatcaaggacgaggagcgcgacgacaccctcaccatcctgctgaaggccacgctcctggccgtgagcggcgtctaccccatgtccatccccgcgaccctgttcgtgtggtacttctggcagaagaagaagcagcggagcggggtgctctgggacaccccctccccgcccgaggtcgagcgcgccgtgctggacgacggcatctaccggatcctgcagcgcggcctgctcgggcggagccaggtgggcgtcggggtgttccaggacggcgtgttccacaccatgtggcacgtcacgcgcggggccgtgctgatgtaccagggcaagcggctggagccctcctgggccagcgtgaagaaggacctcatctcctacggcgggggctggcgcttccaggggagctggaacaccggcgaggaggtccaggtgatcgccgtggagcccgggaagaacccgaagaacgtccagaccacccccggcacgttcaagacccccgagggcgaggtgggggcgatcgccctggacttcaagcccggcacctccgggagcccgatcgtgaaccgggagggcaagatcgtcggcctgtacgggaacggcgtggtgaccacgtccgggacctacgtcagcgccatcgcccaggccaagaccagccaggagggccccctccccgagatcgaggaggaggtgttcaagaagcgcaacctgaccatcatggacctgcacccggggtccggcaagacgcggcgctacctccccgcgatcgtgcgggaggccatcaagcgcaagctgcgcaccctgatcctcgcccccacccgggtcgtggccagcgagatggcggaggccctgaagggcatgcccatccgctaccagaccacggccgtgaagtccgagcacaccgggcgggagatcgtcgacctgatgtgccacgccaccttcaccatgcgcctcctgagcccggtgcgggtgcccaactacaacatgatcatcatggacgaggcccacttcacggaccccgcgtccatcgccgcccgcggctacatcagcacccgggtcgggatgggcgaggccgccgcgatcttcatgaccgccacgccgcccgggtccgtggaggccttcccccagagcaacgccgtgatccaggacgaggagcgcgacatccccgagcggtcctggaacagcggctacgactggatcacggacttccccggcaagaccgtctggttcgtgccctccatcaagagcgggaacgacatcgccaactgcctgcgcaagaacggcaagcgggtgatccagctctcccgcaagaccttcgacaccgagtaccagaagacgaagaacaacgactgggactacgtcgtgaccaccgacatcagcgagatgggggcgaacttccgggccgaccgcgtgatcgacccccggcgctgcctgaagcccgtcatcctgaaggacggccccgagcgggtgatcctcgccgggccgatgcccgtgaccgtcgcctccgcggcccagcgccggggccgcatcggccgcaaccagaacaaggagggggaccagtacgtgtacatgggccagcccctgaacaacgacgaggaccacgcccactggacggaggccaagatgctgctcgacaacatcaacacccccgaggggatcatcccggccctgttcgagcccgagcgggagaagtccgcggccatcgacggcgagtaccgcctgcgcggggaggcccgcaagaccttcgtcgagctcatgcggcgcggcgacctgcccgtgtggctgtcctacaaggtggccagcgagggcttccagtactccgaccggcgctggtgcttcgacggggagcggaacaaccaggtcctcgaggagaacatggacgtggagatctggaccaaggagggcgagcgcaagaagctgcggccccgctggctggacgcccggacgtacagcgacccgctcgcgctgcgcgagttcaaggagttcgccgccgggcggcgcagcgtgtccggcgacctgatcctcgagatcggcaagctgccccagcacctgaccctccgggcccagaacgccctggacaacctggtcatgctccacaacagcgagcagggcgggaaggcgtaccgccacgccatggaggagctgcccgacaccatcgagaccctgatgctcctggccctgatcgccgtgctcaccgggggcgtgacgctgttcttcctgtccgggaagggcctcggcaagaccagcatcgggctgctgtgcgtcatggcgtccagcgccctcctgtggatggccaacgtggagccccactggatcgccgcctccatcatcctggagttcttcctcatggtgctgctgatcccggagcccgaccggcagcgcacgccccaggacaaccagctcgcgtacgtcgtgatcggcctgctgttcatgatcctcaccgtggccgccaacgagatggggctgctggagacgaccaagaaggacctcggcatcgggcacgtcgccgccgagaaccagcaccacgcgaccatgctggacgtggacctgcggccggccagcgcctggaccctctacgccgtggccacgaccgtcatcacccccatgatgcgccacaccatcgagaacacgaccgcgaacatctccctgaccgccatcgccaaccaggccgccatcctgatgggcctcgacaagggctggcccatcagcaagatggacatcggggtgcccctgctggcgctcggctgctactcccaggtgaacccgctgaccctgacggccgccgtcctcatgctggtggcccactacgcgatcatcgggcccggcctgcaggccaaggccacccgcgaggcccagaagcggaccgccgcggggatcatgaagaaccccaccgtggacggcatcgtcgccatcgacctcgaccccgtggtgtacgacgccaagttcgagaagcagctgggccagatcatgctgctcatcctgtgcacgagccagatcctgctcatgcgcaccacctgggccctgtgcgagtccatcaccctggccacggggccgctcaccaccctgtgggagggcagccccgggaagttctggaacaccacgatcgcggtctccatggccaacatcttccggggcagctacctggccggcgccgccctcgcgttctccctgatgaagtccctcgggggcgggcgccgggggaccggggcccagggcgagaccctcggcgagaagtggaagcgccagctgaaccagctgtccaagagcgagttcaacacctacaagcggagcgggatcatggaggtggaccgctccgaggccaaggagggcctcaagcgcggggagacgaccaagcacgccgtgagccgcggcaccgcgaagctgcggtggttcgtcgagcgcaacctggtgaagcccgaggggaaggtgatcgacctgggctgcggccgcggcgggtggtcctactactgcgccgggctcaagaaggtcaccgaggtgaaggggtacacgaagggcgggcccggccacgaggagccgatccccatggccacctacgggtggaacctggtgaagctgtacagcggcaaggacgtcttcttcacgccgcccgagaagtgcgacaccctcctgtgcgacatcggggagtccagcccgaaccccaccatcgaggagggccgcacgctgcgggtgctcaagatggtggagccctggctgcgcgggaaccagttctgcatcaagatcctgaacccctacatgccgtccgtcgtggagaccctcgagcagatgcagcggaagcacggcggcatgctggtgcgcaaccccctgagccggaactccacccacgagatgtactgggtcagctgcgggaccggcaacatcgtgtccgccgtgaacatgacgagccgcatgctcctgaaccgcttcaccatgacccaccggaagcccacctacgagcgcgacgtcgacctgggggccggcacgcggcacgtggcggtggagcccgaggtcgccaacctcgacatcatcggccagcgcatcgagaacatcaagaacgagcacaagtccacctggcactacgacgaggacaacccgtacaagacctgggcctaccacgggagctacgaggtgaagccctccggcagcgcctccagcatggtgaacggggtcgtgcggctgctgaccaagccctgggacgtcatccccatggtgacgcagatcgccatgaccgacaccaccccgttcggccagcagcgcgtgttcaaggagaaggtcgacacgcggacgccccgggcgaagcgggggaccgcccagatcatggaggtgaccgccaagtggctctggggcttcctgtcccgcaacaagaagccccggatctgcacgcgcgaggagttcacccggaaggtgcgcagcaacgccgccatcggcgcggtcttcgtggacgagaaccagtggaacagcgccaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggcgaaggggtcccgggccatctggtacatgtggctgggcgcccgcttcctcgagttcgaggccctgggcttcatgaacgaggaccactggttcagccgggagaactccttcagcggggtggagggcgaggggctgcacaagctcggctacatcctgcgcgacatctccaagatccccgggggcaacatgtacgccgacgacaccgcgggctgggacacgcgcatcaccgaggacgacctgcagaacgaggccaagatcaccgacatcatggaggccgagcacgccctcctggccaccagcatcttcaagctgacgtaccagaacaaggtcgtgcgggtgcagcgccccgcgaagaacgggaccgtcatggacgtgatctcccggcgcgaccagcggggcagcggccaggtggggacctacggcctcaacaccttcacgaacatggaggtccagctgatccgccagatggagtccgaggggatcttcctgcccagcgagctcgagacccccaacctggccgagcgggtgctggactggctcgagaagcacggcaccgagcgcctgaagcggatggccatctccggggacgactgcgtggtcaagccggtggacgaccgcttcgccaccgccctgatcgcgctcaacgacatgggcaaggtgcggaaggacatcccccagtgggagcccagcaaggggtggaacgactggcagcaggtccccttctgctcccaccacttccaccagctgatcatgaaggacggccgcgagatcgtggtgccgtgccggaaccaggacgagctggtcggccgcgcccgggtgagccagggggccggctggtccctccgcgagacggcctgcctgggcaagagctacgcccagatgtggcagctgatgtacttccaccggcgcgacctccggctggcggccaacgccatctgctccgccgtgcccgtcgactgggtgcccaccagccgcaccacctggagcatccacgcgcaccaccagtggatgaccacggaggacatgctgtccgtgtggaaccgcgtctggatcgaggagaacccctggatggaggacaagacccacgtgagctcctgggaggaggtgccgtacctcggcaagcgggaggaccagtggtgcgggagcctgatcggcctgaccgcccgcgccacctgggccacgaacatccaggtcgccatcaaccaggtgcggcgcctcatcggcaacgagaactacctggactacatgacctccatgaagcggttcaagaacgagagcgaccccgagggggcgctgtggtga

SEQ ID NO: 8212 - RNA, 9879 nt, synthetic construct
  misc_feature 1..9879: note = derived and/or modified CDS sequence (opt1) from DENV-1__FJ410175__SS-prME
  source 1..9879: mol_type = other RNA
agcgtgaccatgctgctcatgctgctgcccaccgccctcgccttccacctgaccacccggggcggggagccccacatgatcgtcagcaagcaggagcggggcaagagcctcctgttcaagaccagcgccgggatcaacatgtgcaccctgatcgccatggacctgggcgagctctgcgaggacaccatgacctacaagtgcccccggatcaccgaggccgagcccgacgacgtggactgctggtgcaacgccaccgacacgtgggtgacctacgggacctgcagccagaccggcgagcaccggcgggacaagcggtccgtcgccctggcgccccacgtgggcctggggctcgagacgcgcaccgagacctggatgagctccgagggcgcctggaagcagatccagaaggtggagacctgggccctgcggcaccccgggttcacggtcaccgccctgttcctcgcgcacgccatcggcaccagcatcacccagaaggggatcatcttcatcctgctgatgctcgtgacgccctccatggccatgcgctgcgtgggcatcggcaaccgggacttcgtcgaggggctgagcggcgccacctgggtggacgtggtcctggagcacgggtcctgcgtgaccaccatggccaaggacaagcccacgctcgacatcgagctgctgaagaccgaggtgaccaaccccgcggtcctccgcaagctgtgcatcgaggccaagatcagcaacaccacgaccgactcccggtgccccacccagggcgaggccaccctggtggaggagcaggacagcaacttcgtgtgccgccggacgttcgtcgaccgcggctgggggaacggctgcggcctcttcggcaaggggtccctgctgacctgcgccaagttcaagtgcgtgaccaagctcgagggcaagatcgtgcagtacgagaacctgaagtacagcgtcatcgtgaccgtgcacacgggcgaccagcaccaggtcgggaacgagaccaccgagcacggcaccatcgccaccatcacgccccaggcgcccacctccgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggaccagcggggccagcacctcccaggagacgtggaaccgccaggacctcctggtgaccttcaagaccgcccacgccaagaagcaggaggtggtcgtgctgggcagccaggagggcgcgatgcacaccgccctcacgggggccaccgagatccagacctccggcaccacgaccatcttcgccgggcacctgaagtgccggctgaagatggacaagctcaccctgaagggcatgagctacgtgatgtgcaccgggtccttcaagctggagaaggaggtcgccgagacgcagcacggcaccgtgctggtgcaggtcaagtacgagggcaccgacgcgccctgcaagatccccttcagcgcccaggacgagaagggggtgacccagaacggccgcctcatcacggccaacccgatcgtgaccgacaaggagaagcccgtcaacatcgagaccgagccgcccttcggggagtcctacatcgtggtgggcgccggcgagaaggcgctgaagctgagctggttcaagaaggggtccagcatcggcaagatgttcgaggccaccgcccgcggggcccgccggatggccatcctcggcgacacggcgtgggacttcgggtccatcggcggcgtcttcaccagcgtggggaagctggtgcaccaggtcttcggcgccgcctacggggtgctgttctccggcgtgagctggaccatgaagatcgggatcggcatcctcctgacctggctgggcctcaactcccgcagcacgtccctgagcatgacctgcatcgccgtcgggatggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggcggacagcccgaagcggctgtccgccgccatcggcaaggcctgggaggagggggtgtgcggcatccgcagcgccacccggctcgagaacatcatgtggaagcagatctccaacgagctgaaccacatcctgctcgagaacgacatgaagttcaccgtggtcgtgggggacgcgaacggcatcctggcccaggggaagaagatgatccgcccccagcccatggagcaccggtacagctggaagtcctggggcaaggccaagatcatcggcgccgacatccagaacaccacgttcatcatcgacgggcccgacaccccggagtgccccgacgaccagcgcgcgtggaacatctgggaggtggaggactacggcttcgggatcttcaccaccaacatctggctgaagctccgggacagctacacgcagatgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacaccctctggagcaacggcgtgctggagtccgagatgatcatccccaagatctacgggggcccgatcagccagcacaactaccgccccgggtacttcacgcagaccgccggcccctggcacctggggaagctcgagctggacttcgacctgtgcgagggcaccaccgtcgtggtggacgagcactgcggcaaccgggggccgtccctccgcacgaccaccgtcaccggcaagatcatccacgagtggtgctgccggagctgcacgctgccgcccctgcgcttccgcggggaggacggctgctggtacgggatggagatccgccccgtgaaggagaaggaggagaacctcgtgcggtccatggtcagcgccggcagcggcgaggtggactccttcagcctggggatcctgtgcgtgtccatcatgatcgaggaggtcatgcgcagccggtggtcccgcaagatgctcatgaccggcaccctggccgtgttcctgctcctgatcatggggcagctgacctggaacgacctcatccgcctgtgcatcatggtgggcgcgaacgccagcgaccggatggggatgggcacgacctacctggccctcatggccaccttcaagatgcgcccgatgttcgccgtcggcctgctgttccggcgcctcacctcccgggaggtgctgctgctcacgatcgggctgagcctggtggcgtccgtcgagctccccaacagcctggaggagctgggcgacgggctcgccatgggcatcatgatgctgaagctgctcaccgagttccagccccaccagctgtggaccaccctgctctccctgacgttcatcaagaccaccctgagcctcgactacgcctggcgcaccatggccatggtgctgtccatcgtcagcctgttccccctctgcctgtccacgaccagccagaagaccacctggctgccggtgctcctgggctccttcgggtgcaagcccctgacgatgttcctcatcaccgagaacaagatctggggccgcaagagctggcccctgaacgaggggatcatggcgatcggcatcgtgtccatcctgctcagcagcctgctgaagaacgacgtccccctcgccgggccgctgatcgccggcggcatgctgatcgcctgctacgtgatctccgggagctccgccgacctcagcctggagaaggcggccgaggtgtcctgggaggaggaggccgagcacagcggcacctcccacaacatcctggtcgaggtgcaggacgacgggaccatgaagatcaaggacgaggagcgcgacgacaccctcacgatcctgctgaaggccaccctcctggccgtgagcggcgtctaccccatgtccatccccgcgaccctgttcgtgtggtacttctggcagaagaagaagcagcggagcggggtgctctgggacaccccctccccgcccgaggtcgagcgcgccgtgctggacgacggcatctaccggatcctgcagcgcggcctgctcgggcggagccaggtgggcgtcggggtgttccaggacggcgtgttccacacgatgtggcacgtcacccgcggggccgtgctgatgtaccagggcaagcggctggagccctcctgggccagcgtgaagaaggacctcatctcctacggcgggggctggcgcttccaggggagctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcacctccgggagcccgatcgtgaaccgggagggcaagatcgtcggcctgtacgggaacggcgtggtgacgacctccgggacctacgtcagcgccatcgcccaggccaagaccagccaggagggccccctccccgagatcgaggaggaggtgttcaagaagcgcaacctgacgatcatggacctgcacccggggtccggcaagacccggcgctacctccccgcgatcgtgcgggaggccatcaagcgcaagctgcgcaccctgatcctcgcccccacccgggtcgtggccagcgagatggcggaggccctgaagggcatgcccatccgctaccagacgaccgccgtgaagtccgagcacaccgggcgggagatcgtcgacctgatgtgccacgccaccttcacgatgcgcctcctgagcccggtgcgggtgcccaactacaacatgatcatcatggacgaggcccacttcaccgaccccgcgtccatcgccgcccgcggctacatcagcacccgggtcgggatgggcgaggccgccgcgatcttcatgaccgccacgcccccggggtccgtggaggccttcccccagagcaacgccgtgatccaggacgaggagcgcgacatccccgagcggtcctggaacagcggctacgactggatcaccgacttccccggcaagaccgtctggttcgtgccgtccatcaagagcgggaacgacatcgccaactgcctgcgcaagaacggcaagcgggtgatccagctctcccgcaagaccttcgacacggagtaccagaagaccaagaacaacgactgggactacgtcgtgaccaccgacatcagcgagatgggggcgaacttccgggccgaccgcgtgatcgacccccggcgctgcctgaagcccgtcatcctgaaggacggccccgagcgggtgatcctcgccgggccgatgcccgtgacggtcgcctccgcggcccagcgccggggccgcatcggccgcaaccagaacaaggagggggaccagtacgtgtacatgggccagcccctgaacaacgacgaggaccacgcccactggaccgaggccaagatgctgctcgacaacatcaacacccccgaggggatcatcccggccctgttcgagcccgagcgggagaagtccgcggccatcgacggcgagtaccgcctgcgcggggaggcccgcaagaccttcgtcgagctcatgcggcgcggcgacctgcccgtgtggctgtcctacaaggtggccagcgagggcttccagtactccgaccggcgctggtgcttcgacggggagcggaacaaccaggtcctcgaggagaacatggacgtggagatctggacgaaggagggcgagcgcaagaagctgcggccccgctggctggacgcccggacctacagcgacccgctcgcgctgcgcgagttcaaggagttcgccgccgggcggcgcagcgtgtccggcgacctgatcctcgagatcggcaagctgccccagcacctgaccctccgggcccagaacgccctggacaacctggtcatgctccacaacagcgagcagggcgggaaggcgtaccgccacgccatggaggagctgcccgacaccatcgagaccctgatgctcctggccctgatcgccgtgctcaccggcggggtgaccctgttcttcctgtccgggaaggggctcggcaagaccagcatcgggctgctgtgcgtcatggcgtccagcgccctcctgtggatggccaacgtggagccccactggatcgccgcctccatcatcctggagttcttcctcatggtgctgctgatcccggagcccgaccggcagcgcacgccccaggacaaccagctcgcgtacgtcgtgatcggcctgctgttcatgatcctcacggtggccgccaacgagatggggctgctggagaccaccaagaaggacctcggcatcgggcacgtcgccgccgagaaccagcaccacgcgaccatgctggacgtggacctgcggccggccagcgcctggacgctctacgccgtggccaccaccgtcatcacccccatgatgcgccacacgatcgagaacaccaccgcgaacatctccctgaccgccatcgccaaccaggccgccatcctgatgggcctcgacaagggctggcccatcagcaagatggacatcggggtgcccctgctggcgctcggctgctactcccaggtgaacccgctgacgctgaccgccgccgtcctcatgctggtggcccactacgcgatcatcgggcccggcctgcaggccaaggccacccgcgaggcccagaagcggaccgccgcggggatcatgaagaaccccacggtggacggcatcgtcgccatcgacctcgaccccgtggtgtacgacgccaagttcgagaagcagctgggccagatcatgctgctcatcctgtgcaccagccagatcctgctcatgcgcaccacctgggccctgtgcgagtccatcacgctggccaccgggccgctcaccaccctgtgggagggcagccccgggaagttctggaacacgaccatcgcggtctccatggccaacatcttccggggcagctacctggccggcgccgggctcgccttctccctgatgaagtccctgggcgggggccgccgggggaccggcgcgcagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgccgtgagccgcgggaccgccaagctgcggtggttcgtcgagcgcaacctggtgaagcccgagggcaaggtgatcgacctgggctgcgggcggggcgggtggtcctactactgcgcgggcctcaagaaggtcacggaggtgaaggggtacaccaagggcggccccgggcacgaggagccgatccccatggccacctacggctggaacctggtgaagctgtacagcgggaaggacgtcttcttcacgccgcccgagaagtgcgacaccctcctgtgcgacatcggcgagtccagcccgaaccccacgatcgaggaggggcgcaccctgcgggtgctcaagatggtggagccctggctgcgcggcaaccagttctgcatcaagatcctgaacccctacatgccgtccgtcgtggagaccctcgagcagatgcagcggaagcacggcgggatgctggtgcgcaaccccctgagccggaactccacccacgagatgtactgggtcagctgcggcacggggaacatcgtgtccgccgtgaacatgaccagccgcatgctcctgaaccgcttcaccatgacccaccggaagcccacgtacgagcgcgacgtcgacctgggcgccggcacccggcacgtggccgtggagcccgaggtcgcgaacctcgacatcatcgggcagcgcatcgagaacatcaagaacgagcacaagtccacctggcactacgacgaggacaacccgtacaagacctgggcctaccacggcagctacgaggtgaagccctccgggagcgcctccagcatggtgaacggcgtcgtgcggctgctgacgaagccctgggacgtcatccccatggtgacccagatcgccatgaccgacaccacgccgttcgggcagcagcgcgtgttcaaggagaaggtcgacacccggacgccccgggccaagcggggcaccgcgcagatcatggaggtgacggccaagtggctctggggcttcctgtcccgcaacaagaagccccggatctgcacccgcgaggagttcacccggaaggtgcgcagcaacgccgccatcggggccgtcttcgtggacgagaaccagtggaacagcgcgaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggccaagggctcccgggcgatctggtacatgtggctgggcgcccgcttcctcgagttcgaggccctggggttcatgaacgaggaccactggttcagccgggagaactccttcagcggcgtggagggggagggcctgcacaagctcgggtacatcctgcgcgacatctccaagatcccgggcggcaacatgtacgccgacgacacggccgggtgggacacccgcatcaccgaggacgacctgcagaacgaggcgcggatcaccgacatcatggagcccgagcacgccctcctggccacgagcatcttcaagctgacctaccagaacaaggtcgtgcgcgtgcagcggcccgccaagaacggcaccgtcatggacgtgatctcccgccgggaccagcgcgggagcggccaggtgggcacctacgggctcaacacgttcaccaacatggaggtccagctgatccggcagatggagtccgagggcatcttcctgcccagcgagctcgagaccccgaacctggccgagcgcgtgctggactggctcgagaagcacgggaccgagcggctgaagcgcatggcgatctccggcgacgactgcgtggtcaagcccgtggacgaccggttcgccacggccctgatcgccctcaacgacatggggaaggtgcgcaaggacatcccccagtgggagcccagcaagggctggaacgactggcagcaggtcccgttctgctcccaccacttccaccagctgatcatgaaggacggccgggagatcgtggtgccctgccgcaaccaggacgagctggtcgggcgggcccgcgtgagccagggcgcggggtggtccctccgggagaccgcctgcctgggcaagagctacgcccagatgtggcagctgatgtacttccaccgccgggacctccgcctggccgccaacgcgatctgctccgccgtgcccgtcgactgggtgcccaccagccgcaccacctggagcatccacgcccaccaccagtggatgacgaccgaggacatgctgtccgtgtggaaccgggtctggatcgaggagaacccgtggatggaggacaagacccacgtgagctcctgggaggaggtgccctacctcgggaagcgcgaggaccagtggtgcggcagcctgatcggcctgaccgcccgggcgacgtgggccaccaacatccaggtcgccatcaaccaggtgcgccggctcatcgggaacgagaactacctggactacatgacctccatgaagcgcttcaagaacgagagcgaccccgagggcgccctgtggtga

SEQ ID NO: 8213 - RNA, 9879 nt, synthetic construct
  misc_feature 1..9879: note = derived and/or modified CDS sequence (opt1) from DENV-1__FJ562105__SS-prME
  source 1..9879: mol_type = other RNA
agcgtgaccatgctgctcatgctgctgcccaccgtgctcgccttccacctgaccacccggggcggggagccccacatgatcgtgggcaagcaggagcggggcaagagcctcctgttcaagaccagcgccggggtgaacatgtgcaccctgatcgccatggacctgggggagctctgcgaggacaccatgacctacaagtgcccccggatcaccgaggccgagcccgacgacgtggactgctggtgcaacgccaccgacacctgggtgacctacgggacctgctcccagaccggcgagcaccggcgggacaagcggagcgtggccctggcgccccacgtcgggctgggcctcgagacccgcaccgagacctggatgtccagcgagggggcctggaagcagatccagaaggtggagacctgggccctgcggcacccgggcttcaccgtgatcgccttcttcctggcccacgcgatcgggacctccatcacccagaagggcatcatcttcatcctcctgatgctggtcacccccagcatggccatgcgctgcgtgggcatcgggaaccgggacttcgtggagggcctctccggggccacgtgggtcgacgtggtgctggagcacggcagctgcgtcaccaccatggccaagaacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcgggtggggcaacgggtgcggcctgttcgggaagggctccctcctgacgtgcgccaagttcaagtgcgtcaccaagctggagggcaagatcgtgcagtacgagaacctcaagtacagcgtgatcgtcaccgtgcacaccggggaccagcaccaggtcggcaacgagacgaccgagcacgggaccatcgccaccatcacgccccaggcgcccacgtccgagatccagctgaccgactacggcgccctgaccctcgactgcagcccccggaccgggctggacttcaacgagatggtgctgctcacgatgaaggagaagtcctggctggtgcacaagcagtggttcctggacctcccgctgccctggaccagcggcgcctccaccagccaggagacctggaaccgccaggacctgctcgtcacgttcaagaccgcccacgccaagaagcaggaggtggtggtcctgggcagccaggagggggcgatgcacaccgccctgaccggcgccacggagatccagacctccgggaccaccacgatcttcgccggccacctcaagtgccggctgaagatggacaagctgaccctcaaggggatgagctacgtgatgtgcaccggctccttcaagctggagaaggaggtggccgagacccagcacggcacggtcctggtccaggtgaagtacgaggggaccgacgcgccctgcaagatccccctgagcacccaggacgagaagggcgtcacccagaacgggcgcctcatcacggccaacccgatcgtgaccgacaaggagaagcccgtgaacatcgagaccgagccgcccttcggcgagtcctacatcatcgtcggcgccggggagaaggccctgaagctgagctggttcaagaagggctccagcatcgggaagatgttcgaggcgaccgcccggggcgcccgccggatggccatcctcggggacacggcctgggacttcggctccatcggcggggtgttcaccagcgtgggcaagctggtccaccaggtgttcgggaccgcgtacggcgtgctgttctccggggtcagctggaccatgaagatcggcatcggcatcctcctgacgtggctggggctcaactcccgcagcgcctccctgagcatgacctgcatcgccgtgggcatggtgaccctgtacctcggggtcatggtgcaggccgactccggctgcgtgatcaactggaaggggcgcgagctgaagtgcggcagcggcatcttcgtcaccaacgaggtgcacacgtggaccgagcagtacaagttccaggccgactccccgaagcggctgagcgcggccatcgggaaggcctgggaggagggcgtgtgcggggtccgcagcgccacccggctcgagaacatcatgtggaagcagatctccaacgagctgaaccacatcctgctcgagaacgacatgaagttcaccgtggtggtcggcgacgccaacgggatcctggcgcagggcaagaagatgatccgcccccagcccatggagcacaagtacagctggaagtcctggggcaaggccaagatcatcggggccgacatccagaacaccacgttcatcatcgacggccccgacaccccggagtgccccgacgaccagcgggcctggaacatctgggaggtggaggactacgggttcggcatcttcaccaccaacatctggctgaagctccgcgacagctacacgcagatgtgcgaccaccggctgatgtccgcggccatcaaggacagcaaggccgtgcacgccgacatgggctactggatcgagtccgagaagaacgagacctggaagctggcccgcgcgagcttcatcgaggtcaagacctgcatctggcccaagtcccacaccctctggagcaacggggtgctggagtccgagatgatcatccccaagatctacggcgggccgatcagccagcacaactaccggcccggctacttcacgcagaccgccgggccctggcacctgggcaagctcgagctggacttcgacctgtgcgagggcaccaccgtggtcgtggacgagcactgcgggaaccgcggcccgtccctccggacgaccaccgtgaccgggaagatcatccacgagtggtgctgccgcagctgcacgctgccgcccctgcggttccgcggcgaggacgggtgctggtacggcatggagatccggcccgtcaaggagaaggaggagaacctcgtgcgctccatggtgagcgccggctccggggaggtcgacagcttcagcctgggcatcctgtgcctctccatcatgatcgaggaggtgatgcggagccgctggtcccggaagatgctgatgaccgggaccctggccgtgttcctcctgctgatcatgggccagctcacctggaacgacctgatccgcctgtgcatcatggtcggggccaacgcgagcgaccgcatgggcatgggcacgacctacctcgccctgatggccaccttcaagatgcggccgatgttcgccgtggggctcctgttccgccggctgacctcccgcgaggtgctgctcctgacgatcggcctgagcctcgtcgcctccgtggagctgcccaacagcctggaggagctcggggacggcctggcgatgggcatcatgatgctgaagctcctgaccgagttccagccccaccagctgtggaccaccctcctgtccctgacgttcatcaagaccaccctcagcctggactacgcctggaagaccatggccatggtcctgtccatcgtgagcctcttccccctgtgcctgtccacgaccagccagaagaccacctggctcccggtgctgctggggtccttcggctgcaagcccctcacgatgttcctgatcaccgagaacaagatctgggggcgcaagagctggcccctgaacgagggcatcatggccatcgggatcgtctccatcctcctgagctccctgctcaagaacgacgtgcccctggcgggcccgctgatcgccggcgggatgctcatcgcctgctacgtgatcagcggcagctccgccgacctgagcctggagaaggccgcggaggtctcctgggaggaggaggccgagcacagcgggacctcccacaacatcctcgtggaggtgcaggacgacggcaccatgaagatcaaggacgaggagcgcgacgacaccctgacgatcctgctcaaggccaccctgctggccgtcagcggggtgtaccccatgtccatccccgccaccctcttcgtgtggtacttctggcagaagaagaagcagcggagcggcgtcctgtgggacaccccctccccgcccgaggtggagcgcgcggtgctggacgacggcatctaccggatcctgcagcgcgggctcctgggccggagccaggtcggggtgggcgtgttccaggacggggtcttccacacgatgtggcacgtgacccgcggcgccgtgctgatgtaccagggcaagcggctcgagccctcctgggccagcgtcaagaaggacctgatctcctacgggggcgggtggcgcttccagggcagctggaacaccggggaggaggtccaggtgatcgccgtcgagcccggcaagaacccgaagaacgtgcagaccacgcccggcaccttcaagacccccgagggggaggtgggcgccgtcgcgctggacttcaagcccgggacctccggcagcccgatcgtgaaccgggagggcaagatcgtggggctctacggcaacggggtcgtgacgacctccggcacctacgtgagcgccatcgcccaggccaaggcctcccaggaggggcccctgcccgagatcgaggacgaggtcttcaagaagcgcaacctgaccatcatggacctccacccgggcagcggcaagacgcggcgctacctgcccgcgatcgtgcgggaggccatcaagcgcaagctgcggaccctcatcctggcccccacccgcgtggtcgccagcgagatggcggaggccctgaaggggatgcccatccgctaccagaccacggccgtgaagtccgagcacaccggccgggagatcgtggacctcatgtgccacgccaccttcaccatgcgcctgctgagcccggtccgggtgcccaactacaacatgatcatcatggacgaggcccacttcacggaccccgcgtccatcgccgcccgcgggtacatcagcacccgggtgggcatgggggaggccgccgcgatcttcatgaccgccacgccgcccggctccgtcgaggccttcccccagagcaacgccgtgatccaggacgaggagcgcgacatccccgagcggtcctggaacagcggctacgactggatcacggacttccccgggaagaccgtgtggttcgtcccctccatcaagagcggcaacgacatcgccaactgcctccgcaagaacgggaagcgggtgatccagctgtcccgcaagaccttcgacaccgagtaccagaagacgaagaacaacgactgggactacgtggtcaccaccgacatcagcgagatgggcgcgaacttccgggccgaccgcgtgatcgacccccggcgctgcctgaagcccgtgatcctcaaggacgggcccgagcgggtcatcctggccggcccgatgcccgtgaccgtcgcctccgcggcccagcgccggggccgcatcgggcggaaccagaacaaggagggcgaccagtacgtgtacatggggcagcccctgaacaacgacgaggaccacgcccactggacggaggccaagatgctcctggacaacatcaacacccccgagggcatcatcccggccctgttcgagcccgagcgcgagaagtccgcggccatcgacggggagtaccgcctccggggcgaggcccgcaagaccttcgtggagctgatgcggcgcggcgacctgcccgtctggctctcctacaaggtggccagcgaggggttccagtactccgaccggcgctggtgcttcgacggcgagcggaacaaccaggtgctggaggagaacatggacgtcgagatctggaccaaggagggggagcgcaagaagctgcggccccgctggctcgacgcccggacgtacagcgacccgctggcgctgcgcgagttcaaggagttcgccgccggccggcgctccgtgagcggcgacctcatcctggagatcgggaagctgccccagcacctcaccctgcgggcccagaacgccctggacaacctcgtgatgctgcacaacagcgagcagggcgggaaggcgtaccgccacgccatggaggagctgcccgacaccatcgagaccctcatgctgctggccctcatcgccgtcctgaccggcggggtgatgctgttcttcctctccggcaagggcctggggaagacgagcatcggcctgctctgcgtgatggcgtccagcgccctgctgtggatggcctccgtcgagccccactggatcgccgccagcatcatcctcgagttcttcctgatggtgctgctcatcccggagcccgaccggcagcgcacgccccaggacaaccagctggcgtacgtggtcatcgggctcctgttcatgatcctgaccgtggccgccaacgagatgggcctgctcgagaccacgaagaaggacctggggatcggccacgtggccgccgagaaccaccaccacgtcaccatgctggacgtggacctccggccggcgtccgcctggaccctgtacgccgtggccaccacggtcatcacccccatgatgcgccacaccatcgagaacaccacggccaacatcagcctgaccgcgatcgccaaccaggccgccatcctcatgggcctggacaaggggtggcccatctccaagatggacatcggcgtgcccctgctcgccctggggtgctacagccaggtgaacccgctgaccctcaccgcggccgtcctgatgctggtggcccactacgccatcatcggccccgggctccaggcgaaggccacgcgggaggcccagaagcgcaccgccgccggcatcatgaagaaccccaccgtggacggcatcgtcgcgatcgacctggaccccgtggtgtacgacgccaagttcgagaagcagctggggcagatcatgctcctgatcctgtgcacctcccagatcctcctgatgcgcacgacctgggccctgtgcgagagcatcaccctcgccaccggcccgctgacgaccctgtgggaggggtcccccggcaagttctggaacaccaccatcgccgtcagcatggcgaacatcttccggggctcctacctcgccggggccggcctggccttcagcctgatgaagtccctcgggggcgggcgccggggcacgggcgcccagggggagaccctgggcgagaagtggaagcgccagctgaaccagctcagcaagtccgagttcaacacctacaagcggagcgggatcatggaggtggaccgcagcgaggcgaaggagggcctgaagcgcggcgagaccacgaagcacgccgtgtcccgcggcaccgccaagctgcggtggttcgtcgagcgcaacctggtgaagcccgagggcaaggtgatcgacctcgggtgcggccgcggcgggtggagctactactgcgccgggctgaagaaggtcaccgaggtgaaggggtacaccaagggcgggcccggccacgaggagccgatccccatggcgacgtacgggtggaacctggtgaagctccactccggcaaggacgtcttcttcacgccgcccgagaagtgcgacaccctgctgtgcgacatcggggagagctccccgaaccccaccatcgaggagggccgcaccctccgggtgctgaagatggtggagccctggctgggcgggaaccagttctgcatcaagatcctcaacccctacatgccgagcgtcgtggagacgctggagcagatgcagcgcaagcacggcgggatgctggtgcggaaccccctctcccgcaacagcacccacgagatgtactgggtctcctgcggcaccggcaacatcgtgagcgccgtgaacatgacctcccggatgctgctgaaccgcttcacgatggcccaccggaagcccacctacgagcgcgacgtcgacctcggggccggcacccgccacgtggccgtggagcccgaggtcgcgaacctggggatcatcggccagcggatcgagaacatcaagaacgagcacaagagcacctggcactacgacgaggacaacccgtacaagacgtgggcctaccacgggtcctacgaggtgaagcccagcggctccgccagctccatggtcaacggcgtggtgcgcctgctcaccaagccctgggacgtcatccccatggtgacccagatcgccatgaccgacacgaccccgttcgggcagcagcgggtgttcaaggagaaggtcgacacccgcacgccccgggccaagcgcggcacggcgcagatcatggaggtgaccgccaagtggctgtgggacttcctgagccggaacaagaagccccgcatctgcacccgggaggagttcatccgcaaggtgcggtccaacgccgccatcggggccgtcttcgtggacgagaaccagtggaacagcgcgaaggaggccgtggaggacgagcgcttctgggacctcgtccaccgggagcgcgagctgcacaagcagggcaagtgcgcgacctgcgtgtacaacatgatggggaagcgggagaagaagctgggcgagttcggcaaggccaaggggagccgcgcgatctggtacatgtggctcggcgcccggttcctggagttcgaggccctggggttcatgaacgaggaccactggttctcccgcgagaacagcctctccggcgtggagggggagggcctgcacaagctgggctacatcctccgggacatcagcaagatccccgggggcaacatgtacgccgacgacacggccgggtgggacacccgcatcaccgaggacgacctgcagaacgaggcgaagatcaccgacatcatggagcccgagcacgccctgctcgccacgtccatcttcaagctgacctaccagaacaaggtcgtgcgggtgcagcgccccgccaagaacggcaccgtcatggacgtgatcagccgccgggaccagcgcggctccggccaggtgggcacctacgggctgaacacgttcaccaacatggaggtccagctcatccggcagatggagagcgagggcatcttcctgccctccgagctggagaccaccaacctcgccgagcgcgtgctggactggctggagaagcacggggtggagcggctcaagcgcatggcgatcagcggcgacgactgcgtcgtgaagccgatcgacgaccggttcgccacggccctgatcgccctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcgggcgggcccgcgtgtcccagggcgcggggtggagcctgcgggagaccgcctgcctcggcaagtcctacgcccagatgtggcagctgatgtacttccaccgccgggacctgcgcctcgccgccaacgcgatctgcagcgccgtgcccgtcgactgggtgcccacctcccggaccacgtggagcatccacgcccaccaccagtggatgaccaccgaggacatgctgagcgtgtggaaccgcgtctggatcgaggagaacccctggatggaggacaagacccacgtgtccagctgggaggaggtgccgtacctgggcaagcgggaggaccagtggtgcgggtccctcatcggcctgaccgcccgcgcgacgtgggccaccaacatccaggtcgccatcaaccaggtgcgccggctgatcgggaacgagaactacctcgactacatgaccagcatgaagcgcttcaagaacgagtccgaccccgagggcgccctgtggtga

SEQ ID NO: 8214 - RNA, 9879 nt, synthetic construct
  misc_feature 1..9879: note = derived and/or modified CDS sequence (opt1) from DENV-1__FJ562106__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacccggaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctcatcacggccaacccgatcgtcaccgacaaggagaagcccgtgaacatcgagaccgagccgcccttcggggagagctacatcatggtgggcgccggcgagaaggcgctgaagctgtcctggttcaagaaggggagctccatcggcaagatgttcgaggccaccgcccgcggggcgcgccggatggccatcctcggcgacacggcgtgggacttcgggagcatcggcggcgtcttcacctccgtggggaagctggtgcaccaggtcttcggcaccgcctacggggtgctgttcagcggcgtgtcctggaccatgaagatcgggatcggcatcctcctgacgtggctgggcctcaacagccgctccgccagcctgtccatgacctgcatcgccgtcgggatggtgaccctgtacctcggcgtgatggtccaggccgacagcgggtgcgtgatcaactggaagggccgcgagctgaagtgcgggtccggcatcttcgtgaccaacgaggtccacacgtggaccgagcagtacaagttccaggcggacagcccgaagcggctgagcgccgccatcggcaaggcctgggaggagggggtgtgcggcatccgctccgccacccggctcgagaacatcatgtggaagcagatcagcaacgagctgaaccacatcctgctcgagaacgacatgaagttcaccgtggtcgtgggggacgcgaacggcatcctggcccaggggaagaagatgatccgcccccagcccatggagcacaagtactcctggaagtcctggggcaaggccaagatcatcggcgccgacatccagaacaccacgttcatcatcgacgggcccgacaccccggagtgccccgacgaccagcgggcgtggaacatctgggaggtggaggactacggcttcgggatcttcaccaccaacatctggctgaagctccgcgactcctacacgcagatgtgcgaccaccggctgatgagcgccgccatcaagaactccaaggccgtccacgccgacatgggctactggatcgagagcgagaagaacgagacctggaagctggcgcgcgcctccttcatcgaggtgaagacctgcatctggcccaagagccacaccctctggtccaacggcgtgctggagagcgagatgatcatccccaagatctacgggggcccgatctcccagcacaactaccggcccgggtacttcacgcagaccgccggcccctggcacctggggaagctcgagctggacttcggcctgtgcgagggcaccaccgtcgtggtggacgagcactgcgggaaccgcggcccgagcctccggacgaccaccgtcaccgggaagatcatccacgagtggtgctgccgctcctgcacgctgccgcccctgcggttccgcggcgaggacgggtgctggtacggcatggagatccggcccgtgaaggagaaggaggagaacctcgtgcgcagcatggtctccgccggcagcggggaggtggacagcttctccctgggcatcctgtgcgtgagcatcatgatcgaggaggtcatgcggtcccgctggagccggaagatgctcatgaccgggaccctggccgtgttcctgctcctgatcatgggccagctgacctggaacgacctcatccgcctgtgcatcatggtgggggcgaacgcctccgaccgcatgggcatgggcacgacctacctggccctcatggccaccttcaagatgcggccgatgttcgccgtcgggctgctgttccgccggctcaccagccgcgaggtgctgctgctcacgatcggcctgtccctggtggcgagcgtcgagctccccaactccctggaggagctgggggacggcctcgccatgggcatcatgatgctgaagctgctcaccgagttccagccccaccagctgtggaccaccctgctcagcctgacgttcatcaagaccaccttctccctggactacgcctggaagaccatggccatggtgctcagcatcgtctccctgttccccctgtgcctcagcacgacctcccagaagaccacctggctgccggtgctgctcgggagcttcggctgcaagcccctgacgatgttcctgatcaccgagaacaagatctgggggcggaagtcctggcccctcaacgagggcatcatggcgatcgggatcgtgagcatcctgctgtccagcctcctgaagaacgacgtccccctggccggcccgctcatcgccggcgggatgctgatcgcctgctacgtgatcagcggctccagcgccgacctgtccctcgagaaggcggccgaggtgagctgggaggaggaggccgagcactccgggaccagccacaacatcctggtcgaggtgcaggacgacggcaccatgaagatcaaggacgaggagcgcgacgacaccctgacgatcctcctgaaggccaccctgctcgccgtgtccggggtctaccccatgagcatccccgcgaccctgttcgtgtggtacttctggcagaagaagaagcagcggtccggcgtgctgtgggacacccccagcccgcccgaggtcgagcgcgccgtgctcgacgacggcatctaccggatcctgcagcgcgggctgctgggccggtcccaggtgggggtcggcgtgttccaggacggggtgttccacacgatgtggcacgtcacccgcggcgccgtgctcatgtaccagggcaagcggctggagcccagctgggcctccgtgaagaaggacctgatcagctacgggggcgggtggcgcttccagggctcctggaacaccggggaggaggtccaggtgatcgccgtggagcccggcaagaacccgaagaacgtccagaccacgcccggcaccttcaagacccccgagggggaggtgggcgcgatcgccctcgacttcaagcccgggaccagcggctccccgatcgtgaaccgggagggcaagatcgtcgggctgtacggcaacggggtggtgacgaccagcggcacctacgtctccgccatcgcccaggccaaggcgagccaggaggggcccctgcccgagatcgaggacgaggtgttcaagaagcgcaacctcaccatcatggacctgcacccgggcagcggcaagacgcggcgctacctgcccgccatcgtgcgggaggccatcaagcgcaagctccggaccctgatcctggcccccacccgcgtcgtggcgtccgagatggccgaggccctcaaggggatgcccatccgctaccagaccacggccgtcaagagcgagcacaccggccgggagatcgtcgacctgatgtgccacgccaccttcaccatgcgcctgctctccccggtgcgggtgcccaactacaacatgatcatcatggacgaggcgcacttcacggaccccgccagcatcgccgcccgcgggtacatctccacccgggtcggcatgggggaggccgcggccatcttcatgaccgccacgccgcccggcagcgtggaggccttcccccagtccaacgccgtgatccaggacgaggagcgcgacatccccgagcggagctggaactccggctacgactggatcacggacttccccgggaagaccgtctggttcgtgcccagcatcaagtccggcaacgacatcgcgaactgcctgcgcaagaacgggaagcgggtgatccagctgagccgcaagaccttcgacaccgagtaccagaagacgaagaacaacgactgggactacgtcgtgaccaccgacatctccgagatgggcgccaacttccgggccgaccgcgtgatcgacccccggcgctgcctcaagcccgtcatcctgaaggacgggcccgagcgggtgatcctggccggcccgatgcccgtgaccgtcgcgagcgccgcccagcgccggggccgcatcgggcggaaccagaacaaggagggcgaccagtacgtgtacatggggcagcccctcaacaacgacgaggaccacgcccactggacggaggccaagatgctgctggacaacatcaacacccccgagggcatcatcccggccctcttcgagcccgagcgcgagaagtccgccgccatcgacggggagtaccgcctgcggggcgaggcccgcaagaccttcgtcgagctgatgcggcgcggcgacctccccgtgtggctgagctacaaggtggcctccgaggggttccagtacagcgaccggcgctggtgcttcgacggcgagcggaacaaccaggtcctggaggagaacatggacgtggagatctggaccaaggagggggagcgcaagaagctccggccccgctggctggacgcgcggacgtactccgacccgctggccctccgcgagttcaaggagttcgccgccggccggcgcagcgtgagcggcgacctgatcctggagatcgggaagctcccccagcacctgaccctgcgggcccagaacgcgctcgacaacctggtcatgctgcacaactccgagcagggcgggaaggcctaccgccacgccatggaggagctccccgacaccatcgagaccctgatgctgctcgccctgatcgcggtgctgaccggcggggtgaccctcttcttcctgagcggcaagggcctggggaagacctccatcggcctcctgtgcgtcatggccagctccgccctgctctggatggccagcgtggagccccactggatcgccgcgtccatcatcctggagttcttcctgatggtgctcctgatcccggagcccgaccggcagcgcacgccccaggacaaccagctggcctacgtcgtgatcgggctcctgttcatgatcctgaccgtggccgccaacgagatgggcctcctggagacgaccaagaaggacctggggatcggccacgtcgccgcggagaaccaccaccacgccaccatgctcgacgtggacctgcggccggccagcgcctggaccctgtacgccgtggcgacgaccgtcatcacccccatgatgcgccacaccatcgagaacacgaccgccaacatctccctcaccgccatcgccaaccaggccgcgatcctgatgggcctggacaaggggtggcccatcagcaagatggacatcggcgtgcccctcctggccctggggtgctactcccaggtgaacccgctcaccctgacggccgccgtcctgatgctcgtggcgcactacgccatcatcggccccgggctgcaggccaaggccacccgggaggcccagaagcgcaccgcggccggcatcatgaagaaccccaccgtggacggcatcgtcgccatcgacctggaccccgtggtgtacgacgccaagttcgagaagcagctcgggcagatcatgctgctgatcctctgcacgagccagatcctgctgatgcgcaccacctgggccctctgcgagtccatcaccctggcgacgggcccgctgaccaccctctgggaggggagccccggcaagttctggaacaccacgatcgccgtctccatggccaacatcttccggggcagctacctggccggggccggcctggcgttctccctcatgaagtccctcgggggcgggcgccgggggaccggcgcccagggggagaccctgggcgagaagtggaagcgccagctcaaccagctgtccaagagcgagttcaacacctacaagcggagcgggatcatggaggtggaccgctccgaggccaaggagggcctgaagcgcggggagacgaccaagcacgccgtgagccgcggcaccgcgaagctccggtggttcgtcgagcgcaacctggtgaagcccgagggcaaggtgatcgacctggggtgcggccgcgggggctggtcctactactgcgccgggctgaagaaggtcaccgaggtgaagggctacacgaagggcgggcccggccacgaggagccgatccccatggccacctacgggtggaacctcgtgaagctgcacagcggcaaggacgtcttcttcacgccgcccgagaagtgcgacaccctgctctgcgacatcggggagtccagcccgaaccccaccatcgaggagggccgcacgctgcgggtgctgaagatggtggagccctggctccgcggcaaccagttctgcatcaagatcctgaacccctacatgccgtccgtcgtggagaccctggagcagatgcagcggaagcacgggggcatgctcgtgcgcaaccccctgagccggaactccacccacgagatgtactgggtcagctgcgggaccggcaacatcgtgtccgccgtgaacatgacgagccgcatgctgctcaaccggttcaccatggcccaccgcaagcccacctacgagcgcgacgtcgacctgggcgcggggacccggcacgtggccgtggagcccgaggtcgccaacctggacatcatcggccagcgcatcgagaacatcaagaacgagcacaagtccacgtggcactacgacgaggacaacccgtacaagacctgggcctaccacgggagctacgaggtgaagccctccggcagcgcctccagcatggtgaacggggtcgtgcggctcctgaccaagccctgggacgtcatccccatggtgacccagatcgcgatgacggacaccaccccgttcggccagcagcgcgtgttcaaggagaaggtcgacacccggacgccccgcgccaagcggggcaccgcccagatcatggaggtgaccgccaagtggctgtgggggttcctctcccgcaacaagaagccccggatctgcacccgcgaggagttcacgcggaaggtgcgcagcaacgccgcgatcggcgccgtcttcgtggacgagaaccagtggaacagcgccaaggaggccgtggaggacgagcggttctgggacctggtccaccgcgagcgggagctgcacaagcaggggaagtgcgcgacctgcgtgtacaacatgatgggcaagcgcgagaagaagctcggggagttcggcaaggccaagggctcccgggccatctggtacatgtggctgggggcccgcttcctggagttcgaggccctcggcttcatgaacgaggaccactggttcagccgggagaactccctgagcggggtggagggcgaggggctgcacaagctcggctacatcctgcgcgacatctccaagatcccgggcgggaacatgtacgcggacgacaccgccggctgggacacccggatcacggaggacgacctgcagaacgaggccaagatcaccgacatcatggagcccgagcacgccctcctggccaccagcatcttcaagctgacctaccagaacaaggtcgtgcgcgtgcagcgccccgcgaagaacgggacggtcatggacgtgatctcccggcgcgaccagcggggcagcggccaggtggggacctacggcctcaacaccttcaccaacatggaggtccagctgatccgccagatggagtccgaggggatcttcctgccctgcgagctcgagacgccgaacctggccgagcgggtgctggactggctcgagaagcacggcgccgagcgcctgaagcggatggccatcagcggggacgactgcgtggtcaagcccatcgacgaccgcttcgccaccgcgctgatcgccctcaacgacatgggcaaggtgcggaaggacatcccccagtgggagccctccaagggctggaacgactggcagcaggtcccgttctgcagccaccacttccaccagctgatcatgaaggacgggcgcgagatcgtcgtgccctgccggaaccaggacgagctggtgggccgcgcccgggtctcccagggggccggctggagcctccgcgagaccgcctgcctggggaagtcctacgcgcagatgtggcagctgatgtacttccaccggcgcgacctccggctggccgccaacgccatctgcagcgcggtgcccgtggactgggtccccacctcccgcacgacctggagcatccacgcccaccaccagtggatgaccaccgaggacatgctgagcgtgtggaaccgggtgtggatcgaggagaacccgtggatggaggacaagacccacgtctccagctgggaggaggtgccctacctcggcaagcgcgaggaccagtggtgcggctccctgatcgggctgacgacccgcgccacctgggccaccaacatccaggtggccatcaaccaggtccggcgcctcatcggcaacgagaactacctggactacatgacgagcatgaagcggttcaagaacgagtccgaccccgagggggcgctgtggtga

SEQ ID NO: 8215 - RNA, 9879 nt, synthetic construct
  misc_feature 1..9879: note = derived and/or modified CDS sequence (opt1) from DENV-1__FJ410179__SS-prME
  source 1..9879: mol_type = other RNA
agcgtgaccatgctgctcatgctgctgcccaccgccctcgccttccacctgaccacccggggcggggagccccacatgatcgtgtccaagcaggagcggggcaagagcctcctgttcaagacctccgccgggatcaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtcgccctggcgccccacgtgggcctggggctcgagacccgcaccgagacctggatgagctccgagggcgcctggaagcagatccagaaggtggagacctgggccctgcggcaccccgggttcacggtgaccgccctgttcctcgcgcacgccatcggcaccagcatcacccagaaggggatcatcttcatcctgctgatgctcgtgacgccctccatggccatgcgctgcgtgggcatcggcaaccgggacttcgtcgaggggctgagcggcgccacctgggtggacgtggtcctggagcacgggtcctgcgtgaccaccatggccaaggacaagcccacgctcgacatcgagctgctgaagaccgaggtgaccaaccccgcggtcctccgcaagctgtgcatcgaggccaagatcagcaacaccacgaccgactcccggtgcccgacccagggcgaggccaccctggtggaggagcaggacagcaacttcgtgtgccgccggacgttcgtcgaccgcggctgggggaacggctgcggcctcttcggcaaggggtccctgctgacctgcgccaagttcaagtgcgtgaccaagctcgagggcaagatcgtgcagtacgagaacctgaagtacagcgtcatcgtgaccgtgcacacgggcgaccagcaccaggtcgggaacgagaccaccgagcacggcaccatcgccaccatcacgccccaggcgcccacctccgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggaccagcggggccagcacctcccaggagacgtggaaccgccaggacctcctggtgaccttcaagaccgcccacgccaagaagcaggaggtggtcgtgctgggcagccaggagggcgcgatgcacaccgccctcacgggggccaccgagatccagacctccggcaccacgaccatcttcgccgggcacctgaagtgccggctgaagatggacaagctcaccctgaagggcatgagctacgtgatgtgcaccgggtccttcaagctggagaaggaggtcgccgagacgcagcacggcaccgtgctggtgcaggtcaagtacgagggcaccgacgcgccctgcaagatccccttcagcgcccaggacgagaagggggtgacccagaacggccgcctcatcacggccaacccgatcgtgaccgacaaggagaagcccgtcaacatcgagaccgagccgcccttcggggagtcctacatcgtggtgggcgccggcgagaaggcgctgaagctgagctggttcaagaaggggtccagcatcggcaagatgttcgaggccaccgcccgcggggcccgccggatggccatcctcggcgacacggcgtgggacttcgggtccatcggcggcgtcttcaccagcgtggggaagctggtgcaccaggtcttcggcgccgcctacggggtgctgttctccggcgtgagctggaccatgaagatcgggatcggcatcctcctgacctggctgggcctcaactcccgcagcacgtccctgagcatgacctgcatcgccgtcgggatggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggcggacagcccgaagcggctgtccgccgccatcggcaaggcctgggaggagggggtgtgcggcatccgcagcgccacccggctcgagaacatcatgtggaagcagatctccaacgagctgaaccacatcctgctcgagaacgacatgaagttcaccgtggtcgtgggggacgcgaacggcatcctggcccaggggaagaagatgatccgcccccagcccatggagcaccggtacagctggaagtcctggggcaaggccaagatcatcggcgccgacatccagaacagcaccttcatcatcgacgggcccgacacgccggagtgccccgacgaccagcgcgcgtggaacatctgggaggtggaggactacggcttcgggatcttcaccaccaacatctggctgaagctccgggactcctacacccagatgtgcgaccaccgcctgatgagcgccgccatcaaggactccaaggccgtccacgccgacatgggctactggatcgagagcgagaagaacgagacgtggaagctggcgcgggcctccttcatcgaggtgaagacctgcatctggcccaagagccacaccctctggtccaacggcgtgctggagagcgagatgatcatccccaagatgtacgggggcccgatctcccagcacaactaccgccccgggtacttcacccagacggccggcccctggcacctggggaagctcgagctggacttcgacctgtgcgagggcaccaccgtcgtggtggacgagcactgcggcaaccgggggccgagcctccgcaccacgaccgtcaccggcaagatcatccacgagtggtgctgccggtcctgcaccctgccgcccctgcgcttccgcggggaggacggctgctggtacgggatggagatccgccccgtgaaggagaaggaggagaacctcgtgcggagcatggtcagcgccggctccggcgaggtggacagcttctccctggggatcctgtgcgtgagcatcatgatcgaggaggtcatgcgctcccggtggagccgcaagatgctcatgacgggcaccctggccgtgttcctgctcctgatcatggggcagctgacctggaacgacctcatccgcctgtgcatcatggtgggcgcgaacgcctccgaccggatggggatgggcaccacgtacctggccctcatggccaccttcaagatgcgcccgatgttcgccgtcgggctgctgttccggcgcctcaccagccgggaggtgctgctgctcaccatcgggctgtccctggtggcgagcgtcgagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggcgcaccatggccatggtgctgagcatcgtctccctgttccccctctgcctgagcaccacgtcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtgagcatcctgctcagctccctgctgaagaacgacgtccccctcgccgggccgctgatcgccggcggcatgctgatcgcctgctacgtgatcagcgggtccagcgccgacctctccctggagaaggcggccgaggtgagctgggaggaggaggccgagcactccggcaccagccacaacatcctggtcgaggtgcaggacgacgggaccatgaagatcaaggacgaggagcgcgacgacaccctcaccatcctgctgaaggccacgctcctggccatctccggcgtgtaccccatgagcatccccgcgaccctgttcgtctggtacttctggcagaagaagaagcagcggtccggggtgctctgggacacccccagcccgcccgaggtggagcgcgccgtcctggacgacggcatctaccggatcctgcagcgcggcctgctcgggcggtcccaggtgggcgtgggggtcttccaggacggcgtgttccacaccatgtggcacgtgacgcgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgccgtggagcccgggaagaacccgaagaacgtgcagaccacccccggcacgttcaagacccccgagggcgaggtcggggcgatcgccctggacttcaagcccggcaccagcgggtccccgatcgtgaaccgggagggcaagatcgtgggcctgtacgggaacggcgtcgtgaccacgagcgggacctacgtgagcgccatcgcccaggccaagacctcccaggagggccccctccccgagatcgaggaggaggtcttcaagaagcgcaacctgaccatcatggacctgcacccggggagcggcaagacgcggcgctacctccccgcgatcgtgcgggaggccatcaagcgcaagctgcgcaccctgatcctcgcccccacccgggtggtcgcctccgagatggcggaggccctgaagggcatgcccatccgctaccagaccacggccgtcaagagcgagcacaccgggcgggagatcgtggacctgatgtgccacgccaccttcaccatgcgcctcctgtccccggtccgggtgcccaactacaacatgatcatcatggacgaggcccacttcacggaccccgcgagcatcgccgcccgcggctacatctccacccgggtggggatgggcgaggccgccgcgatcttcatgaccgccacgccgcccgggagcgtcgaggccttcccccagtccaacgccgtgatccaggacgaggagcgcgacatccccgagcggagctggaactccggctacgactggatcacggacttccccggcaagaccgtgtggttcgtccccagcatcaagtccgggaacgacatcgccaactgcctgcgcaagaacggcaagcgggtgatccagctcagccgcaagaccttcgacaccgagtaccagaagacgcggaacaacgactgggactacgtggtcaccaccgacatctccgagatgggggcgaacttccgcgccgaccgggtgatcgacccccgccggtgcctgaagcccgtgatcctgaaggacggccccgagcgcgtcatcctcgccgggccgatgcccgtgaccgtggccagcgcggcccagcggcgcggccgcatcggccggaaccagaacaaggagggggaccagtacgtctacatgggccagcccctgaacaacgacgaggaccacgcccactggacggaggccaagatgctgctcgacaacatcaacacccccgaggggatcatcccggccctgttcgagcccgagcgcgagaagtccgcggccatcgacggcgagtaccggctgcgcggggaggcccggaagaccttcgtggagctcatgcgccggggcgacctgcccgtctggctgagctacaaggtggcctccgagggcttccagtacagcgaccgccggtggtgcttcgacggggagcgcaacaaccaggtgctcgaggagaacatggacgtcgagatctggaccaaggagggcgagcggaagaagctgcgcccccggtggctggacgcccgcacgtacagcgacccgctcgcgctgcgggagttcaaggagttcgccgccgggcgccggtccgtgagcggcgacctgatcctcgagatcggcaagctgccccagcacctgaccctccgcgcccagaacgccctggacaacctggtgatgctccacaactccgagcagggcgggaaggcgtaccggcacgccatggaggagctgcccgacaccatcgagaccctgatgctcctggccctgatcgccgtcctcaccgggggcgtgacgctgttcttcctgagcgggaagggcctcggcaagacctccatcgggctgctgtgcgtgatggcgagctccgccctcctgtggatggccaacgtcgagccccactggatcgccgccagcatcatcctggagttcttcctcatggtgctgctgatcccggagcccgaccgccagcggacgccccaggacaaccagctcgcgtacgtggtcatcggcctgctgttcatgatcctcaccgtggccgccaacgagatggggctgctggagacgaccaagaaggacctcggcatcgggcacgtggccgccgagaaccagcaccacgcgaccatgctggacgtcgacctgcgcccggcctccgcctggaccctctacgccgtggccacgaccgtgatcacccccatgatgcgccacaccatcgagaacacgaccgcgaacatcagcctgaccgccatcgccaaccaggccgccatcctgatgggcctcgacaagggctggcccatctccaagatggacatcggggtccccctgctggcgctcggctgctacagccaggtgaacccgctgaccctgacggccgccgtgctcatgctggtcgcccactacgcgatcatcgggcccggcctgcaggccaaggccacccgggaggcccagaagcgcaccgccgcggggatcatgaagaaccccaccgtggacggcatcgtggccatcgacctcgaccccgtcgtgtacgacgccaagttcgagaagcagctgggccagatcatgctgctcatcctgtgcacgtcccagatcctgctcatgcggaccacctgggccctgtgcgagagcatcaccctggccacggggccgctcaccaccctgtgggagggctcccccgggaagttctggaacaccacgatcgcggtgagcatggccaacatcttccgcggctcctacctggccggcgccgggctcgccttcagcctgatgaagtccctgggcgggggccggcgcgggaccggcgcgcagggcgagaccctcggggagaagtggaagcggcagctgaaccagctgagcaagagcgagttcaacacctacaagcgctccggcatcatggaggtcgaccggagcgaggccaaggaggggctcaagcgcggcgagacgaccaagcacgccgtgtcccgggggaccgccaagctgcgctggttcgtggagcggaacctggtcaagcccgagggcaaggtgatcgacctgggctgcgggcgcggcgggtggagctactactgcgcgggcctcaagaaggtgaccgaggtcaaggggtacacgaagggcggccccgggcacgaggagccgatccccatggccacctacggctggaacctggtgaagctgtactccgggaaggacgtgttcttcacgccgcccgagaagtgcgacaccctcctgtgcgacatcggcgagagctccccgaaccccaccatcgaggaggggcggacgctgcgcgtcctcaagatggtggagccctggctgcggggcaaccagttctgcatcaagatcctgaacccctacatgccgagcgtggtcgagaccctcgagcagatgcagcgcaagcacggcgggatgctggtgcggaaccccctgtcccgcaacagcacccacgagatgtactgggtgtcctgcggcaccgggaacatcgtcagcgccgtgaacatgacgtcccgcatgctcctgaaccggttcaccatgacccaccgcaagcccacctacgagcgggacgtggacctgggcgccggcacgcgccacgtcgccgtggagcccgaggtggcgaacctcgacatcatcgggcagcggatcgagaacatcaagaacgagcacaagagcacctggcactacgacgaggacaacccgtacaagacctgggcctaccacggctcctacgaggtcaagcccagcgggtccgccagctccatggtgaacggcgtggtccgcctgctgaccaagccctgggacgtgatccccatggtcacgcagatcgccatgaccgacaccaccccgttcgggcagcagcgggtgttcaaggagaaggtggacacgcgcacgccccgggccaagcgcggcaccgcgcagatcatggaggtcaccgccaagtggctctggggcttcctgagccggaacaagaagccccgcatctgcacgcgggaggagttcacccgcaaggtgcggagcaacgccgccatcggggccgtgttcgtcgacgagaaccagtggaactccgcgaaggaggccgtggaggacgagcgcttctgggacctggtgcaccgggagcgcgagctccacaagcagggcaagtgcgcgacctgcgtctacaacatgatggggaagcgggagaagaagctgggcgagttcgggaaggccaagggcagccgcgcgatctggtacatgtggctgggcgcccggttcctcgagttcgaggccctggggttcatgaacgaggaccactggttctcccgcgagaacagcttctccggcgtggagggggagggcctgcacaagctcgggtacatcctgcgcgacatcagcaagatcccgggcggcaacatgtacgccgacgacaccgccgggtgggacacgcggatcaccgaggacgacctgcagaacgaggcgaagatcaccgacatcatggagcccgagcacgccctcctggccacctccatcttcaagctgacgtaccagaacaaggtggtccgcgtgcagcggcccgccaagaacggcaccgtgatggacgtcatcagccgccgggaccagcgcgggtccggccaggtgggcacctacgggctcaacaccttcacgaacatggaggtgcagctgatccggcagatggagagcgagggcatcttcctgccctccgagctcgagaccccgaacctggccgagcgcgtcctggactggctcgagaagcacgggaccgagcggctgaagcgcatggcgatcagcggcgacgactgcgtggtgaagcccgtcgacgaccggttcgccaccgccctgatcgccctcaacgacatggggaaggtgcgcaaggacatcccccagtgggagccctccaagggctggaacgactggcagcaggtcccgttctgcagccaccacttccaccagctgatcatgaaggacggccgggagatcgtcgtgccctgccgcaaccaggacgagctggtggggcgggcccgcgtctcccagggcgcggggtggagcctccgggagacggcctgcctgggcaagtcctacgcccagatgtggcagctgatgtacttccaccgccgggacctccgcctggccgccaacgcgatctgcagcgccgtgcccgtggactgggtccccaccagccgcaccacctggtccatccacgcccaccaccagtggatgaccacggaggacatgctgagcgtgtggaaccgggtgtggatcgaggagaacccgtggatggaggacaagacccacgtctccagctgggaggaggtgccctacctcgggaagcgcgaggaccagtggtgcggctccctgatcggcctgaccgcccgggcgacctgggccacgaacatccaggtggccatcaaccaggtccgccggctcatcgggaacgagaactacctggactacatgaccagcatgaagcgcttcaagaacgagtccgaccccgagggcgccctgtggtga

SEQ ID NO: 8216 - RNA, 9879 nt, synthetic construct
  misc_feature 1..9879: note = derived and/or modified CDS sequence (opt1) from DENV-1__FJ410181__SS-prME
  source 1..9879: mol_type = other RNA
agcgtgaccatgctgctcatgctgctgcccaccgccctcgccttccacctgaccacccggggcggggagccccacatgatcgtcagcaagcaggagcggggcaagagcctcctgttcaagaccagcgtggggatcaacatgtgcaccctgatcgccatggacctgggcgagctctgcgaggacaccatgacctacaagtgcccccggatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctggggctcgagacgcgcaccgagacctggatgagctccgagggcgcctggaagcagatccagaaggtcgagacctgggccctgcggcaccccgggttcacggtgaccgccctgttcctcgcccacgcgatcggcaccagcatcacccagaaggggatcatcttcatcctgctgatgctcgtgacgccctccatggccatgcgctgcgtcggcatcggcaaccgggacttcgtggaggggctgagcggcgccacctgggtggacgtcgtgctggagcacgggtcctgcgtgaccaccatggccaaggacaagcccacgctcgacatcgagctgctgaagaccgaggtcaccaaccccgccgtgctccgcaagctgtgcatcgaggcgaagatcagcaacaccacgaccgactcccggtgccccacccagggcgaggccaccctggtggaggagcaggacagcaacttcgtctgccgccggacgttcgtggaccgcggctgggggaacggctgcggcctcttcggcaaggggtccctgctgacctgcgccaagttcaagtgcgtgaccaagctcgagggcaagatcgtccagtacgagaacctgaagtacagcgtgatcgtgaccgtccacacgggcgaccagcaccaggtggggaacgagaccaccgagcacggcaccatcgccaccatcacgccccaggcccccacctccgagatccagctgaccgactacggggcgctcaccctggactgcagcccccggacgggcctggacttcaacgagatggtcctcctgaccatgaaggagaagtcctggctggtgcacaagcagtggttcctcgacctgccgctgccctggaccagcggggccagcacctcccaggagacgtggaaccgccaggacctcctggtgaccttcaagaccgcccacgccaagaagcaggaggtcgtggtgctgggcagccaggagggcgccatgcacaccgcgctcacgggggccaccgagatccagacctccggcaccacgaccatcttcgccgggcacctgaagtgccggctgaagatggacaagctcaccctgaagggcatgagctacgtcatgtgcaccgggtccttcaagctggagaaggaggtggccgagacgcagcacggcaccgtgctggtccaggtgaagtacgagggcaccgacgccccctgcaagatccccttcagcgcgcaggacgagaagggggtgacccagaacggccgcctcatcacggccaacccgatcgtcaccgacaaggagaagcccgtgaacatcgagaccgagccgcccttcggggagtcctacatcgtgatcggcgccggcgagaaggccctgaagctgagctggttcaagaaggggtccagcatcggcaagatgttcgaggcgaccgcccgcggggcccgccggatggccatcctcggcgacacggcctgggacttcgggtccatcggcggcgtcttcaccagcgtggggaagctggtgcaccaggtcttcggcgcggcctacggggtgctgttctccggcgtgagctggaccatgaagatcgggatcggcatcctcctgacctggctgggcctcaactcccgcagcacgtccctgagcatgacctgcatcgccgtcgggatggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggccgacagcccgaagcggctgtccgcggccatcggcaaggcctgggaggagggggtgtgcggcatccgcagcgccacccggctcgagaacatcatgtggaagcagatctccaacgagctgaaccacatcctgctcgagaacgacatgaagttcaccgtggtcgtgggggacgccaacggcatcctggcgcaggggaagaagatgatccgcccccagcccatggagcaccggtacagctggaagtcctggggcaaggccaagatcatcggcgccgacatccagaacaccacgttcatcatcgacgggcccgacaccccggagtgccccgacgaccagcgcgcctggaacatctgggaggtggaggactacggcttcgggatcttcaccaccaacatctggctgaagctccgggacagctacacgcagatgtgcgaccaccgcctgatgtccgcggccatcaaggacagcaaggccgtccacgccgacatgggctactggatcgagtccgagaagaacgagacctggaagctggcccgggcgagcttcatcgaggtgaagacctgcatctggcccaagtcccacaccctctggagcaacggcgtgctggagtccgagatgatcatccccaagatctacgggggcccgatcagccagcacaactaccgccccgggtacttcacgcagaccgccggcccctggcacctggggaagctcgagctggacttcgacctgtgcgagggcaccaccgtcgtggtggacgagcactgcggcaaccgggggccgtccctccgcacgaccaccgtcaccggcaagatcatccacgagtggtgctgccggagctgcacgctgccgcccctgcgcttccgcggggaggacggctgctggtacgggatggagatccgccccgtgaaggagaaggaggagaacctcgtgcggtccatggtcagcgccggcagcggcgaggtggactccttcagcctggggatcctgtgcgtgtccatcatgatcgaggaggtcatgcgcagccggtggtcccgcaagatgctcatgaccggcaccctggccgtgttcctgctcctgatcatggggcagctgacctggaacgacctcatccgcctgtgcatcatggtgggcgccaacgcgagcgaccggatggggatgggcacgacctacctggccctcatggccaccttcaagatgcgcccgatgttcgccgtcggcctgctgttccggcgcctcacctcccgggaggtgctgctgctcacgatcgggctgagcctggtggcctccgtcgagctccccaacagcctggaggagctgggcgacgggctcgcgatgggcatcatgatgctgaagctgctcaccgagttccagccccaccagctgtggaccaccctgctctccctgacgttcatcaagaccaccctgagcctcgactacgcctggcgcaccatggccatggtgctgtccatcgtcagcctgttccccctctgcctgtccacgaccagccagaagaccacctggctgccggtgctcctgggctccttcgggtgcaagcccctgacgatgttcctcatcaccgagaacaagatctggggccgcaagagctggcccctgaacgaggggatcatggccatcggcatcgtgtccatcctgctcagcagcctgctgaagaacgacgtccccctcgcggggccgctgatcgccggcggcatgctgatcgcctgctacgtgatctccgggagctccgccgacctcagcctggagaaggccgcggaggtgtcctgggaggaggaggccgagcacagcggcacctcccacaacatcctggtcgaggtgcaggacgacgggaccatgaagatcaaggacgaggagcgcgacgacaccctcacgatcctgctgaaggccaccctcctggccgtgagcggcgtctaccccatgtccatccccgccaccctgttcgtgtggtacttctggcagaagaagaagcagcggagcggggtgctctgggacaccccctccccgcccgaggtcgagcgcgcggtgctggacgacggcatctaccggatcctgcagcgcggcctgctcgggcggagccaggtgggcgtcggggtgttccaggacggcgtgttccacacgatgtggcacgtcacccgcggggccgtgctgatgtaccagggcaagcggctggagccctcctgggccagcgtgaagaaggacctcatctcctacggcgggggctggcgcttccaggggagctggaacaccggcgaggaggtccaggtgatcgccgtggagcccgggaagaacccgaagaacgtccagaccacgcccggcaccttcaagacccccgagggcgaggtgggggccatcgcgctggacttcaagcccggcacctccgggagcccgatcgtgaaccgggagggcaagatcgtcggcctgtacgggaacggcgtggtgacgacctccgggacctacgtcagcgccatcgcccaggccaagaccagccaggagggccccctccccgagatcgaggacgaggtgttcaagaagcgcaacctgacgatcatggacctgcacccggggtccggcaagacccggcgctacctccccgccatcgtgcgggaggcgatcaagcgcaagctgcgcaccctgatcctcgcccccacccgggtcgtggccagcgagatggccgaggcgctgaagggcatgcccatccgctaccagacgaccgccgtgaagtccgagcacaccgggcgggagatcgtcgacctgatgtgccacgccaccttcacgatgcgcctcctgagcccggtgcgggtgcccaactacaacatgatcatcatggacgaggcccacttcaccgaccccgcctccatcgcggcccgcggctacatcagcacccgggtcgggatgggcgaggccgccgccatcttcatgaccgcgacgcccccggggtccgtggaggccttcccccagagcaacgccgtgatccaggacgaggagcgcgacatccccgagcggtcctggaacagcggctacgactggatcaccgacttccccggcaagaccgtctggttcgtgccgtccatcaagagcgggaacgacatcgccaactgcctgcgcaagaacggcaagcgggtgatccagctctcccgcaagaccttcgacacggagtaccagaagaccaagaacaacgactgggactacgtcgtgaccaccgacatcagcgagatgggggccaacttccgggcggaccgcgtgatcgacccccggcgctgcctgaagcccgtcatcctgaaggacggccccgagcgggtgatcctcgccgggccgatgcccgtgacggtcgcctccgccgcgcagcgccggggccgcatcggccgcaaccagaacaaggagggggaccagtacgtgtacatgggccagcccctgaacaacgacgaggaccacgcccactggaccgaggccaagatgctgctcgacaacatcaacacccccgaggggatcatcccggccctgttcgagcccgagcgggagaagtccgccgcgatcgacggcgagtaccgcctgcgcggggaggcccgcaagaccttcgtcgagctcatgcggcgcggcgacctgcccgtgtggctgtcctacaaggtggccagcgagggcttccagtactccgaccggcgctggtgcttcgacggggagcggaacaaccaggtcctcgaggagaacatggacgtggagatctggacgaaggagggcgagcgcaagaagctgcggccccgctggctggacgcccggacctacagcgacccgctcgccctgcgcgagttcaaggagttcgcggccgggcggcgcagcgtgtccggcgacctgatcctcgagatcggcaagctgccccagcacctgaccctccgggcccagaacgccctggacaacctggtcatgctccacaacagcgagcagggcgggaaggcctaccgccacgcgatggaggagctgcccgacaccatcgagaccctgatgctcctggccctgatcgccgtgctcaccggcggggtgaccctgttcttcctgtccgggaaggggctcggcaagaccagcatcgggctgctgtgcgtcatggcctccagcgcgctcctgtggatggccaacgtggagccccactggatcgccgcctccatcatcctggagttcttcctcatggtgctgctgatcccggagcccgaccggcagcgcacgccccaggacaaccagctcgcctacgtcgtgatcggcctgctgttcatgatcctcacggtggcggccaacgagatggggctgctggagaccaccaagaaggacctcggcatcgggcacgtcgccgccgagaaccagcaccacgccaccatgctggacgtggacctgcggccggcgagcgcctggacgctctacgccgtggccaccaccgtcatcacccccatgatgcgccacacgatcgagaacaccaccgccaacatctccctgaccgcgatcgccaaccaggccgccatcctgatgggcctcgacaagggctggcccatcagcaagatggacatcggggtgcccctgctggccctcggctgctactcccaggtgaacccgctgacgctgaccgcggccgtcctcatgctggtggcccactacgccatcatcgggcccggcctgcaggcgaaggccacccgcgaggcccagaagcggaccgccgccgggatcatgaagaaccccacggtggacggcatcgtcgcgatcgacctcgaccccgtggtgtacgacgccaagttcgagaagcagctgggccagatcatgctgctcatcctgtgcaccagccagatcctgctcatgcgcaccacctgggccctgtgcgagtccatcacgctggccaccgggccgctcaccaccctgtgggagggcagccccgggaagttctggaacacgaccatcgccgtctccatggcgaacatcttccggggcagctacctggccggcgccgggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggcgaaggaggggctcaagcggggcgagaccaccaagcacgccgtgagccgcgggaccgccaagctgcggtggttcgtcgagcgcaacctggtgaagcccgagggcaaggtgatcgacctgggctgcgggcggggcgggtggtcctactactgcgccggcctcaagaaggtcacggaggtgaaggggtacaccaagggcggccccgggcacgaggagccgatccccatggcgacctacggctggaacctggtgaagctgtacagcgggaaggacgtcttcttcacgccgcccgagaagtgcgacaccctcctgtgcgacatcggcgagtccagcccgaaccccacgatcgaggaggggcgcaccctgcgggtgctcaagatggtggagccctggctgcgcggcaaccagttctgcatcaagatcctgaacccctacatgccgtccgtcgtggagaccctcgagcagatgcagcggaagcacggcgggatgctggtgcgcaaccccctgagccggaactccacccacgagatgtactgggtcagctgcggcacggggaacatcgtgtccgccgtgaacatgaccagccgcatgctcctgaaccgcttcaccatggcccaccggaagcccacctacgagcgcgacgtcgacctgggcgccggcacgcggcacgtggccgtggagcccgaggtcgcgaacctcgacatcatcgggcagcgcatcgagaacatcaagaacgagcacaagtccacctggcactacgacgaggacaacccgtacaagacctgggcctaccacggcagctacgaggtgaagccctccgggagcgcctccagcatggtgaacggcgtcgtgcggctgctgaccaagccctgggacgtcatccccatggtgacgcagatcgccatgaccgacaccaccccgttcgggcagcagcgcgtgttcaaggagaaggtcgacacgcggacgccccgggccaagcggggcaccgcgcagatcatggaggtgaccgccaagtggctctggggcttcctgtcccgcaacaagaagccccggatctgcacgcgcgaggagttcacccggaaggtgcgcagcaacgccgccatcggggccgtcttcgtggacgagaaccagtggaacagcgcgaaggaggccgtggaggacgagcggttctgggacctggtctaccgcgagcgggagctccacaagcagggcaagtgcgcgacctgcgtgtacaacatgatggggaagcgcgagaagaagctgggcgagttcgggaaggccaagggctcccgggcgatctggtacatgtggctgggcgcccgcttcctcgagttcgaggccctggggttcatgaacgaggaccactggttcagccgggagaactccttcagcggcgtggagggggagggcctgcacaagctcgggtacatcctgcgcgacatctccaagatcccgggcggcaacatgtacgccgacgacaccgccgggtgggacacgcgcatcaccgaggacgacctgcagaacgaggcgaagatcaccgacatcatggagcccgagcacgccctcctggccaccagcatcttcaagctgacgtaccagaacaaggtcgtgcgggtgcagcgccccgccaagaacggcaccgtcatggacgtgatctcccggcgcgaccagcgggggagcggccaggtgggcacctacgggctcaacaccttcacgaacatggaggtccagctgatccgccagatggagtccgagggcatcttcctgcccagcgagctcgagaccccgaacctggccgagcgggtgctggactggctcgagaagcacgggaccgagcgcctgaagcggatggcgatctccggcgacgactgcgtggtcaagcccgtggacgaccgcttcgccaccgccctgatcgccctcaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctggtcgggcgcgcccgggtgagccagggcgcggggtggtccctccgcgagacggcctgcctgggcaagagctacgcccagatgtggcagctgatgtacttccaccggcgcgacctccggctggccgccaacgcgatctgctccgccgtgcccgtcgactgggtgcccaccagccgcaccacctggagcatccacgcccaccaccagtggatgaccacggaggacatgctgtccgtgtggaaccgcgtctggatcgaggagaacccgtggatggaggacaagacccacgtgagctcctgggaggaggtgccctacctcgggaagcgggaggaccagtggtgcggcagcctgatcggcctgaccgcccgcgcgacctgggccacgaacatccaggtcgccatcaaccaggtgcggcgcctcatcgggaacgagaactacctggactacatgacctccatgaagcggttcaagaacgagagcgaccccgagggcgccctgtggtga

SEQ ID NO: 8217 - RNA, 9879 nt, synthetic construct
  misc_feature 1..9879: note = derived and/or modified CDS sequence (opt1) from DENV-1__FJ547086__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgccggggtgaacatgtgcaccctgatcgccatggacctgggcgagctctgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagaaggtcgagacctgggccctgcggcaccccgggttcacggtgatcgccttcttcctggcgcacgccatcggcaccagcatcacccagaaggggatcatcttcatcctcctgatgctggtgaccccctccatggccatgcgctgcgtcggcatcggcaaccgggacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcgcaagctctgcatcgaggccaagatcagcaacaccaccacggactcccggtgcccgacccagggcgaggccaccctggtggaggagcaggacgccaacttcgtctgccgccggaccttcgtggaccgcggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccgccaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccggctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctgatcacggccaacccgatcgtcaccgacaaggagaagcccgtgaacatcgagaccgagccgcccttcggggagagctacatcatggtgggcgccggcgagaaggcgctcaagctgtcctggttcaagaaggggagctccatcggcaagatgttcgaggccaccgcccgcggggcccgccggatggccatcctgggcgacacggcgtgggacttcgggagcatcggcggcgtcttcacctccgtggggaagctcgtgcaccaggtcttcggcaccgcctacggggtgctgttcagcggcgtgtcctggaccatgaagatcgggatcggcatcctgctcacgtggctgggcctgaacagccgctccgccagcctctccatgacctgcatcgccgtcgggatggtgaccctgtacctgggcgtgatggtccaggccgacagcgggtgcgcgatcaactggaagggccgcgagctcaagtgcgggtccggcatcttcgtgaccaacgaggtgcacacgtggaccgagcagtacaagttccaggccgacagcccgaagcggctgagcgccgccatcggcaaggcctgggaggagggggtctgcggcatccgctccgcgacccggctggagaacatcatgtggaagcagatcagcaacgagctcaaccacatcctgctggagaacgacatgaagttcaccgtggtggtcggggacgccaacggcatcctcgcccaggggaagaagatgatccgcccccagcccatggagcacaagtactcctggaagtcctggggcaaggccaagatcatcggcgcggacatccagaacaccacgttcatcatcgacgggcccgacaccccggagtgccccgacgaccagcgggcctggaacatctgggaggtggaggactacggcttcgggatcttcaccaccaacatctggctgaagctgcgcgactcctacacgcagatgtgcgaccaccggctcatgagcgccgccatcaaggactccaaggccgtgcacgcggacatgggctactggatcgagagcgagaagaacgagacctggaagctggcccgcgcctccttcatcgaggtcaagacctgcatctggcccaagagccacaccctgtggtccaacggcgtgctcgagagcgagatgatcatccccaagatctacgggggcccgatctcccagcacaactaccggcccgggtacttcacgcagaccgccggcccctggcacctggggaagctggagctcgacttcgacctgtgcgagggcaccaccgtggtcgtggacgagcactgcggcaaccgcgggccgagcctgcggacgaccaccgtgaccggcaagatcatccacgagtggtgctgccgctcctgcacgctgccgcccctgcggttccgcggggaggacggctgctggtacgggatggagatccggcccgtcaaggagaaggaggagaacctggtgcgcagcatggtgtccgccggcagcggcgaggtcgacagcttctccctcgggatcctgtgcgtgagcatcatgatcgaggaggtgatgcggtcccgctggagccggaagatgctgatgaccggcaccctcgcggtcttcctgctgctcatcatggggcagctgacctggaacgacctgatccgcctctgcatcatggtgggcgccaacgcctccgaccgcatggggatgggcacgacctacctggccctgatggccaccttcaagatgcggccgatgttcgcggtgggcctcctgttccgccggctgaccagccgcgaggtcctcctgctgacgatcgggctctccctggtggccagcgtggagctgcccaactccctcgaggagctgggcgacgggctggccatgggcatcatgatgctcaagctgctgaccgagttccagccccaccagctctggaccaccctgctgagcctcacgttcatcaagaccaccctgtccctggactacgcctggaagaccatggcgatggtcctcagcatcgtgtccctgttccccctgtgcctcagcacgacctcccagaagaccacctggctgccggtcctgctcggcagcttcgggtgcaagcccctgacgatgttcctgatcaccgagaacaagatctggggccggaagtcctggcccctcaacgaggggatcatggccatcggcatcgtgagcatcctgctgtccagcctcctgaagaacgacgtgcccctggccgggccgctcatcgccggcggcatgctgatcgcctgctacgtcatcagcgggtccagcgcggacctgtccctcgagaaggccgccgaggtgagctgggaggaggaggccgagcactccggcaccagccacaacatcctggtggaggtccaggacgacgggaccatgaagatcaaggacgaggagcgcgacgacaccctgacgatcctcctgaaggccaccctgctcgcggtgtccggcgtgtaccccatgagcatccccgccaccctgttcgtctggtacttctggcagaagaagaagcagcggtccggggtgctgtgggacacccccagcccgcccgaggtggagcgcgccgtcctcgacgacggcatctaccggatcctgcagcgcggcctgctggggcggtcccaggtgggcgtgggggtcttccaggacggcgtgttccacacgatgtggcacgtgacccgcggggccgtcctcatgtaccagggcaagcggctggagcccagctgggcctccgtgaagaaggacctgatcagctacggcgggggctggcgcttccaggggtcctggaacaccggcgaggaggtgcaggtcatcgcggtggagcccgggaagaacccgaagaacgtgcagaccacgcccggcaccttcaagacccccgagggcgaggtcggggccatcgccctcgacttcaagcccggcaccagcgggtccccgatcgtgaaccgggagggcaagatcgtgggcctgtacgggaacggcgtcgtgacgaccagcgggacctacgtgtccgccatcgcccaggcgaaggccagccagcagggccccctgcccgagatcgaggacgaggtcttcaagaagcgcaacctcaccatcatggacctgcacccggggagcggcaagacgcggcgctacctgcccgccatcgtgcgggaggccatcaagcgcaagctccggaccctgatcctggcgcccacccgcgtggtcgcctccgagatggccgaggccctcaagggcatgcccatccgctaccagaccacggccgtcaagagcgagcacaccgggcgggagatcgtggacctgatgtgccacgcgaccttcaccatgcgcctgctctccccggtccgggtgcccaactacaacatgatcatcatggacgaggcccacttcacggaccccgccagcatcgccgcccgcggctacatctccacccgggtggggatgggcgaggcggccgccatcttcatgaccgccacgccgcccgggagcgtcgaggccttcccccagtccaacgcggtgatccaggacgaggagcgcgacatccccgagcggagctggaactccggctacgactggatcacggacttccccggcaagaccgtgtggttcgtccccagcatcaagtccgggaacgacatcgccaactgcctgcgcaagaacggcaagcgggtgatccagctgagccgcaagaccttcgacaccgagtaccagaagacgaagaacaacgactgggactacgtggtcaccaccgacatctccgagatgggggccaacttccgggccgaccgcgtgatcgacccccggcgctgcctcaagcccgtgatcctgaaggacggccccgagcgggtcatcctggcggggccgatgcccgtgaccgtggccagcgccgcccagcgccggggccgcatcggccggaaccagaacaaggagggggaccagtacgtctacatgggccagcccctcaacaacgacgaggaccacgcccactggacggaggcgaagatgctgctggacaacatcaacacccccgaggggatcatcccggccctcttcgagcccgagcgcgagaagtccgccgccatcgacggcgagtaccgcctgcgcggggaggcccgcaagaccttcgtggagctgatgcggcgcggcgacctccccgtctggctgagctacaaggtggcgtccgagggcttccagtacagcgaccggcgctggtgcttcgacggggagcggaacaaccaggtgctggaggagaacatggacgtcgagatctggaccaaggagggcgagcgcaagaagctccggccccgctggctggacgcccggacgtactccgacccgctggccctccgcgagttcaaggagttcgccgccgggcggcgcagcgtgagcggcgacctgatcctggagatcggcaagctcccccagcacctgaccctgcgggcgcagaacgccctcgacaacctggtgatgctgcacaactccgagcagggcgggaaggcctaccgccacgccatggaggagctccccgacaccatcgagaccctgatgctgctcgcgctgatcgccgtcctgaccgggggcgtgaccctcttcttcctgagcgggaagggcctgggcaagacctccatcgggctcctgtgcgtgatggccagctccgccctgctctggatggccagcgtcgagccccactggatcgcggcctccatcatcctggagttcttcctgatggtgctcctgatcccggagcccgaccggcagcgcacgccccaggacaaccagctggcctacgtggtcatcggcctcctgttcatgatcctgaccgtggccgccaacgagatggggctcctggagacgaccaagaaggacctgggcatcgggcacgtggcggccgagaaccaccaccacgccaccatgctcgacgtcgacctgcggccggccagcgcctggaccctgtacgcggtggccacgaccgtgatcacccccatgatgcgccacaccatcgagaacacgaccgccaacatctccctcaccgccatcgccaaccaggcggccatcctgatgggcctggacaagggctggcccatcagcaagatggacatcggggtccccctcctggccctgggctgctactcccaggtgaacccgctcaccctgacggccgcggtgctgatgctcgtcgcccactacgccatcatcgggcccggcctgcaggccaaggccacccgggaggcgcagaagcgcaccgccgccgggatcatgaagaaccccaccgtggacggcatcgtggccatcgacctggaccccgtcgtgtacgacgccaagttcgagaagcagctcggccagatcatgctgctgatcctctgcacgagccagatcctgctgatgcgcaccacctgggcgctctgcgagtccatcaccctggccacggggccgctgaccaccctctgggagggcagccccgggaagttctggaacaccacgatcgccgtgtccatggccaacatcttccggggcagctacctggccggcgcggggctggccttctccctcatgaagtccctgggcgggggccgccgggggaccggcgcccagggcgagaccctgggggagaagtggaagcgccagctcaaccagctgtccaagagcgagttcaacacctacaagcggagcggcatcatggaggtcgaccgctccgaggccaaggaggggctgaagcggggcgagacgaccaagcacgcggtgagccgcgggaccgccaagctccggtggttcgtggagcgcaacctggtcaagcccgagggcaaggtgatcgacctgggctgcgggcggggcgggtggtcctactactgcgccggcctgaagaaggtgaccgaggtcaaggggtacacgaagggcggccccgggcacgaggagccgatccccatggccacctacggctggaacctcgtgaagctgcacagcgggaaggacgtgttcttcacgccgcccgagaagtgcgacaccctgctctgcgacatcggcgagtccagcccgaaccccaccatcgaggaggggcgcacgctgcgggtcctgaagatggtggagccctggctccgcggcaaccagttctgcatcaagatcctgaacccctacatgccgtccgtggtcgagaccctggagcagatgcagcggaagcacggcgggatgctcgtgcgcaaccccctgagccggaactccacccacgagatgtactgggtgagctgcggcaccgggaacatcgtctccgccgtgaacatgacgagccgcatgctgctcaaccggttcaccatggcgcaccgcaagcccacctacgagcgcgacgtggacctgggcgccggcacccggcacgtcgccgtggagcccgaggtggccaacctggacatcatcgggcagcgcatcgagaacatcaagaacgagcacaagtccacgtggcactacgacgaggacaacccgtacaagacctgggcctaccacggcagctacgaggtcaagccctccgggagcgcgtccagcatggtgaacggcgtggtccggctcctgaccaagccctgggacgtgatccccatggtcacccagatcgccatgacggacaccaccccgttcgggcagcagcgcgtgttcaaggagaaggtggacacccggacgccccgcgccaagcggggcaccgcccagatcatggaggtcaccgccaagtggctgtggggcttcctctcccgcaacaagaagccccggatctgcacccgcgaggagttcacgcggaaggtgcgcagcaacgcggccatcggggccgtgttcgtcgacgagaaccagtggaacagcgccaaggaggcggtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggctcccgggccatctggtacatgtggctgggcgcccgcttcctggagttcgaggcgctcgggttcatgaacgaggaccactggttcagccgggagaactccctgagcggcgtggagggggagggcctgcacaagctcgggtacatcctgcgcgacatctccaagatcccgggcggcaacatgtacgccgacgacaccgccgggtgggacacccggatcacggaggacgacctgcagaacgaggccaagatcaccgacatcatggagcccgagcacgccctcctggcgaccagcatcttcaagctgacctaccagaacaaggtggtccgcgtgcagcgccccgccaagaacggcacggtgatggacgtcatctcccggcgcgaccagcgggggagcggccaggtgggcacctacgggctcaacaccttcaccaacatggaggtgcagctgatccgccagatggagtccgagggcatcttcctgccctgcgagctcgagacgccgaacctggccgagcgggtcctggactggctcgagaagcacggggccgagcgcctgaagcggatggccatcagcggcgacgactgcgtggtgaagcccatcgacgaccgcttcgcgaccgccctgatcgccctcaacgacatggggaaggtccggaaggacatcccccagtgggagccctccaagggctggaacgactggcagcaggtcccgttctgcagccaccacttccaccagctgatcatgaaggacggccgcgagatcgtggtcccctgccggaaccaggacgagctggtggggcgcgcccgggtgtcccagggcgccgggtggagcctccgcgagaccgcgtgcctgggcaagtcctacgcccagatgtggcagctgatgtacttccaccggcgcgacctccggctggccgccaacgcgatctgcagcgccgtccccgtggactgggtgcccacctcccgcacgacctggagcatccacgcccaccaccagtggatgaccaccgaggacatgctgagcgtctggaaccgggtgtggatcgaggagaacccgtggatggaggacaagacccacgtgtccagctgggaggaggtcccctacctcgggaagcgcgaggaccagtggtgcggctccctgatcggcctgacggcccgcgccacctgggcgaccaacatccaggtggccatcaaccaggtgcggcgcctcatcgggaacgagaactacctggactacatgaccagcatgaagcggttcaagaacgagtccaaccccgagggcgccctgtggtga

SEQ ID NO: 8218 - RNA, 9879 nt, synthetic construct
  misc_feature 1..9879: note = derived and/or modified CDS sequence (opt1) from DENV-1__FJ410183__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagacctccgccgggatcaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgggacaagcggtccgtcgccctggcgccccacgtgggcctggggctcgagacgcgcaccgagacctggatgagctccgagggcgcctggaagcagatccagaaggtggagacctgggccctgcggcaccccgggttcacggtcaccgccttcttcctggcgcacgccatcggcaccagcatcacccagaaggggatcatcttcatcctcctgatgctggtgacgccctccatggccatgcgctgcgtgggcatcggcaaccgggacttcgtcgaggggctcagcggcgccacctgggtggacgtggtcctggagcacgggtcctgcgtgaccaccatggccaaggacaagcccacgctggacatcgagctcctgaagaccgaggtgaccaaccccgcggtcctgcgcaagctctgcatcgaggccaagatcagcaacaccacgaccgactcccggtgcccgacccagggcgaggccaccctggtggaggagcaggacagcaacttcgtgtgccgccggacgttcgtcgaccgcggctgggggaacggctgcgggctgttcggcaaggggtccctcctgacctgcgccaagttcaagtgcgtgaccaagctggagggcaagatcgtgcagtacgagaacctcaagtacagcgtcatcgtgaccgtgcacacgggcgaccagcaccaggtcgggaacgagaccaccgagcacggcaccatcgccaccatcacgccccaggcgcccacctccgagatccagctgaccgactacggggccctgaccctcgactgcagcccccggacgggcctggacttcaacgagatggtgctgctcaccatgaaggagaagtcctggctggtccacaagcagtggttcctggacctcccgctgccctggaccagcggggccagcacctcccaggagacgtggaaccgccaggacctgctcgtgaccttcaagaccgcccacgccaagaagcaggaggtggtcgtgctgggcagccaggagggcgcgatgcacaccgccctgacgggggccaccgagatccagacctccggcaccacgaccatcttcgccgggcacctcaagtgccggctgaagatggacaagctgaccctcaagggcatgagctacgtgatgtgcaccgggtccttcaagctggagaaggaggtcgccgagacgcagcacggcaccgtgctggtgcaggtcaagtacgagggcaccgacgcgccctgcaagatccccttcagcgcccaggacgagaagggggtgacccagaacggccgcctgatcacggccaacccgatcgtgaccgacaaggagaagcccgtcaacatcgagaccgagccgcccttcggggagtcctacatcgtggtgggcgccggcgagaaggcgctcaagctgagctggttcaagaaggggtccagcatcggcaagatgttcgaggccaccgcccgcggggcccgccggatggccatcctgggcgacacggcgtgggacttcgggtccatcggcggcgtcttcaccagcgtggggaagctcgtgcaccaggtcttcggcgccgcctacggggtgctgttctccggcgtgagctggaccatgaagatcgggatcggcatcctgctcacctggctgggcctgaactcccgcagcacgtccctcagcatgacctgcatcgccgtcgggatggtgaccctgtacctgggcgtgatggtccaggccgactccgggtgcgtgatcaactggaagggccgcgagctcaagtgcgggagcggcatcttcgtgaccaacgaggtccacacgtggaccgagcagtacaagttccaggcggacagcccgaagcggctgtccgccgccatcggcaaggcctgggaggagggggtgtgcggcatccgcagcgccacccggctggagaacatcatgtggaagcagatctccaacgagctcaaccacatcctgctggagaacgacatgaagttcaccgtggtcgtgggggacgcgaacggcatcctcgcccaggggaagaagatgatccgcccccagcccatggagcaccggtacagctggaagtcctggggcaaggccaagatcatcggcgccgacatccagaacaccacgttcatcatcgacgggcccgacaccccggagtgccccgacgaccagcgcgcgtggaacatctgggaggtggaggactacggcttcgggatcttcaccaccaacatctggctgaagctgcgggacagctacacgcagatgtgcgaccaccgcctcatgtccgccgccatcaaggacagcaaggccgtccacgccgacatgggctactggatcgagtccgagaagaacgagacctggaagctggcgcgggccagcttcatcgaggtgaagacctgcatctggcccaagtcccacaccctgtggagcaacggcgtgctcgagtccgagatgatcatccccaagatgtacgggggcccgacgagccagcacaactaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctgcgcttccgcggggaggacggctgctggtacgggatggagatccgccccgtgaaggagaaggaggagaacctggtgcggtccatggtcagcgccggcagcggcgagatggactccttcagcctcgggatcctgtgcgtgtccatcatgatcgaggaggtgatgcgcagccggtggtcccgcaagatgctgatgaccggcaccctcgccgtcttcctgctgctcatcatggggcagctgacgtggaacgacctgatccgcctctgcatcatggtgggcgcgaacgccagcgaccggatggggatgggcaccacctacctggccctgatggccaccttcaagatgcgcccgatgttcgccgtgggcctcctgttccggcgcctgacgtcccgggaggtcctcctgctgaccatcgggctcagcctggtggcgtccgtggagctgcccaacagcctcgaggagctgggcgacgggctggccatgggcatcatgatgctcaagctgctgaccgagttccagccccaccagctctggaccacgctgctgtccctcaccttcatcaagaccaccctgagcctggactacgcctggcgcacgatggccatggtcctctccatcgtgagcctgttccccctgtgcctctccaccaccagccagaagaccacgtggctgccggtcctgctcggctccttcgggtgcaagcccctgaccatgttcctgatcaccgagaacaagatctggggccgcaagagctggcccctcaacgaggggatcatggcgatcggcatcgtgtccatcctgctgagcagcctcctgaagaacgacgtgcccctggccgggccgctcatcgccggcggcatgctgatcgcctgctacgtcatctccgggagctccgccgacctgagcctcgagaaggcggccgaggtgtcctgggaggaggaggccgagcacagcggcacctcccacaacatcctggtggaggtccaggacgacgggaccatgaagatcaaggacgaggagcgcgacgacacgctgaccatcctcctgaaggccaccctgctcgccgtgagcggcgtgtaccccatgtccatccccgcgaccctgttcgtctggtacttctggcagaagaagaagcagcggagcggggtgctgtgggacacgccctccccgcccgaggtggagcgcgccgtcctcgacgacggcatctaccggatcctgcagcgcggcctgctggggcggagccaggtgggcgtgggggtcttccaggacggcgtgttccacaccatgtggcacgtgacccgcggggccgtcctcatgtaccagggcaagcggctggagccctcctgggccagcgtgaagaaggacctgatctcctacggcgggggctggcgcttccaggggagctggaacaccggcgaggaggtgcaggtcatcgccgtggagcccgggaagaacccgaagaacgtgcagacgacccccggcaccttcaagacccccgagggcgaggtcggggcgatcgccctcgacttcaagcccggcacgtccgggagcccgatcgtgaaccgggagggcaagatcgtgggcctgtacgggaacggcgtcgtgaccacctccgggacctacgtgagcgccatcgcccaggccaagacgagccaggagggccccctgcccgagatcgaggacgaggtcttcaagaagcgcaacctcaccatcatggacctgcacccggggtccggcaagacccggcgctacctgcccgcgatcgtgcgggaggccatcaagcgcaagctccgcaccctgatcctggcccccacgcgggtggtcgccagcgagatggcggaggccctcaagggcatgcccatccgctaccagaccaccgccgtgaagtccgagcacaccgggcgggagatcgtggacctgatgtgccacgccacgttcaccatgcgcctgctcagcccggtccgggtgcccaactacaacatgatcatcatggacgaggcccacttcaccgaccccgcgtccatcgccgcccgcggctacatcagcacccgggtggggatgggcgaggccgccgcgatcttcatgacggccacgccgcccgggtccgtcgaggccttcccccagagcaacgccgtgatccaggacgaggagcgcgacatccccgagcggtcctggaacagcggctacgactggatcaccgacttccccggcaagaccgtgtggttcgtcccctccatcaagagcgggaacgacatcgccaactgcctgcgcaagaacggcaagcgggtgatccagctgtcccgcaagacgttcgacaccgagtaccagaagaccaagaacaacgactgggactacgtggtcaccacggacatcagcgagatgggggcgaacttccgggccgaccgcgtgatcgacccccggcgctgcctcaagcccgtgatcctgaaggacggccccgagcgggtcatcctggccgggccgatgcccgtgaccgtggcctccgcggcccagcgccggggccgcatcggccgcaaccagaacaaggagggggaccagtacgtctacatgggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgcgcggggaggcccgcaagacgttcgtggagctgatgcggcgcggcgacctccccgtctggctgtcctacaaggtggccagcgagggcttccagtactccgaccggcgctggtgcttcgacggggagcggaacaaccaggtgctggaggagaacatggacgtcgagatctggaccaaggagggcgagcgcaagaagctccggccccgctggctggacgcccggacctacagcgacccgctggcgctccgcgagttcaaggagttcgccgccgggcggcgcagcgtgtccggcgacctgatcctggagatcggcaagctcccccagcacctgaccctgcgggcccagaacgccctcgacaacctggtgatgctgcacaacagcgagcagggcgggaaggcgtaccgccacgccatggaggagctccccgacaccatcgagacgctgatgctgctcgccctgatcgccgtcctgaccgggggcgtgaccctcttcttcctgtccgggaagggcctgggcaagaccagcatcgggctcctgtgcgtgatggcgtccagcgccctgctctggatggccaacgtcgagccccactggatcgccgcctccatcatcctggagttcttcctgatggtgctcctgatcccggagcccgaccggcagcgcacgccccaggacaaccagctggcgtacgtggtcatcggcctcctgttcatcatcctgaccgtggccgccaacgagatggggctcctggagaccaccaagaaggacctgggcatcgggcacgtggccgccgagagccagcaccacgcgacgatgctcgacgtcgacctgcggccggcctccgcctggaccctgtacgccgtggccaccaccgtgatcacgcccatgatgcgccacaccatcgagaacaccaccgcgaacatcagcctcacggccatcgccaaccaggccgccatcctgatgggcctggacaagggctggcccatctccaagatggacatcggggtccccctcctggcgctgggctgctacagccaggtgaacccgctcaccctgaccgccgccgtgctgatgctcgtcgcccactacgcgatcatcgggcccggcctgcaggccaaggccacccgcgaggcccagaagcggacggccgcggggatcatgaagaaccccaccgtggacggcatcgtggccatcgacctggaccccgtcgtgtacgacgccaagttcgagaagcagctcggccagatcatgctgctgatcctctgcacctcccagatcctgctgatgcgcaccacgtgggccctctgcgagagcatcaccctggccaccgggccgctgaccacgctctgggagggctcccccgggaagttctggaacaccaccatcgcggtgagcatggccaacatcttccggggctcctacctggccggcgccgggctggccttcagcctcatgaagtccctgggcgggggccgccgggggaccggcgcgcagggcgagacgctgggggagaagtggaagcgccagctcaaccagctgagcaagagcgagttcaacacctacaagcggtccggcatcatggaggtcgaccgcagcgaggccaaggaggggctgaagcggggcgagaccaccaagcacgccgtgtcccgcgggacggccaagctccggtggttcgtggagcgcaacctggtcaagcccgagggcaaggtgatcgacctgggctgcgggcggggcgggtggagctactactgcgcgggcctgaagaaggtgaccgaggtcaaggggtacaccaagggcggccccgggcacgaggagccgatccccatggccacctacggctggaacctcgtgaagctgtactccgggaaggacgtgttcttcacgccgcccgagaagtgcgacacgctgctctgcgacatcggcgagagctccccgaaccccaccatcgaggaggggcgcaccctgcgggtcctgaagatggtggagccctggctccgcggcaaccagttctgcatcaagatcctgaacccctacatgccgagcgtggtcgagaccctggagcagatgcagcggaagcacggcgggatgctcgtgcgcaaccccctgtcccggaacagcacgcacgagatgtactgggtgtcctgcggcaccgggaacatcgtcagcgccgtgaacatgacctcccgcatgctgctcaaccgcttcaccatggcccaccggaagcccacgtacgagcgcgacgtggacctgggcgccggcacccggcacgtcgcggtggagcccgaggtggccaacctggacatcatcgggcagcgcatcgagaacatcaagaacgagcacaagagcacctggcactacgacgaggacaacccgtacaagacctgggcctaccacggctcctacgaggtcaagcccagcgggtccgccagctccatggtgaacggcgtggtccggctcctgacgaagccctgggacgtgatccccatggtcacccagatcgccatgaccgacaccacgccgttcgggcagcagcgcgtgttcaaggagaaggtggacacccggacgccccgggcgaagcggggcaccgcccagatcatggaggtcacggccaagtggctgtggggcttcctcagccgcaacaagaagccccggatctgcacccgcgaggagttcacccggaaggtgcgcagcaacgccgccatcggggcggtgttcgtcgacgagaaccagtggaactccgccaaggaggccgtggaggacgagcggttctgggacctggtgcaccgcgagcgggagctgcacaagcagggcaagtgcgcgacctgcgtctacaacatgatggggaagcgcgagaagaagctcggcgagttcgggaaggcgaagggcagccgggccatctggtacatgtggctgggcgcccgcttcctggagttcgaggccctcgggttcatgaacgaggaccactggttctcccgggagaacagcttctccggcgtggagggggagggcctgcacaagctggggtacatcctccgcgacatcagcaagatcccgggcggcaacatgtacgccgacgacacggcggggtgggacacccgcatcaccgaggacgacctgcagaacgaggccaagatcaccgacatcatggagcccgagcacgccctgctcgccacgtccatcttcaagctgacctaccagaacaaggtggtccgggtgcagcgccccgccaagaacggcaccgtgatggacgtcatcagccggcgcgaccagcgggggtccggccaggtgggcacctacgggctgaacacgttcaccaacatggaggtgcagctcatccgccagatggagagcgagggcatcttcctgccctccgagctggagaccccgaacctcgcggagcgggtcctggactggctggagaagcacgggaccgagcgcctcaagcggatggccatcagcggcgacgactgcgtggtgaagcccgtcgacgaccgcttcgccacggccctgatcgccctgaacgacatggggaaggtgcggaaggacatcccccagtgggagccctccaagggctggaacgactggcagcaggtcccgttctgcagccaccacttccaccagctcatcatgaaggacggccgcgagatcgtcgtgccctgccggaaccaggacgagctggtggggcgcgcgcgggtctcccagggcgccgggtggagcctgcgcgagaccgcctgcctcggcaagtcctacgcccagatgtggcagctgatgtacttccaccggcgcgacctgcggctcgccgcgaacgccatctgcagcgccgtgcccgtggactgggtccccaccagccgcaccacctggtccatccacgcccaccaccagtggatgacgaccgaggacatgctgagcgtgtggaaccgcgtgtggatcgaggagaacccgtggatggaggacaagacccacgtctccagctgggaggaggtgccctacctggggaagcgggaggaccagtggtgcggctccctcatcggcctgaccgcgcgcgccacgtgggccaccaacatccaggtggccatcaaccaggtccggcgcctgatcgggaacgagaactacctcgactacatgaccagcatgaagcggttcaagaacgagtccgaccccgagggcgccctgtggtga

SEQ ID NO: 8219 - RNA, 9879 nt, synthetic construct
  misc_feature 1..9879: note = derived and/or modified CDS sequence (opt1) from DENV-1__FJ410184__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcggggatcaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgggacaagcggtccgtcgccctggcgccccacgtgggcctggggctcgagacgcgcaccgagacctggatgagctccgagggcgcctggaagcagatccagaaggtggagacctgggccctgcggcaccccgggttcacggtcatcgccctgttcctcgcgcacgccatcggcaccagcatcacccagaaggggatcatcttcatcctgctgatgctcgtgaccccctccatggccatgcgctgcgtgggcatcggcaaccgggacttcgtcgaggggctgagcggcgccacgtgggtggacgtggtcctggagcacgggtcctgcgtgaccaccatggccaaggacaagcccaccctcgacatcgagctgctgaagacggaggtgaccaaccccgcggtcctccgcaagctgtgcatcgaggccaagatcagcaacaccaccacggactcccggtgccccacccagggcgaggccaccctggtggaggagcaggacgccaacttcgtgtgccgccggaccttcgtcgaccgcggctgggggaacggctgcggcctgttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagaagtcctggctggtccacaagcagtggttcctcgacctgcccctgccctggacctccggggccagcaccagccaggagacctggaaccgccaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtcgcggagacccagcacggcacggtgctggtgcaggtcaagtacgagggcaccgacgccccctgcaagatccccttctccgcccaggacgagaagggggtgacccagaacggccgcctcatcaccgccaacccgatcgtgacggacaaggagaagcccgtcaacatcgagaccgagccgcccttcggggagagctacatcgtggtgggcgcgggcgagaaggccctgaagctgtcctggttcaagaaggggagctccatcggcaagatgttcgaggccaccgcccgcggggcgcgccggatggcgatcctcggcgacaccgcctgggacttcgggagcatcggcggcgtcttcacgtccgtggggaagctggtgcaccaggtcttcggcaccgcctacggggtgctgttcagcggcgtgtcctggaccatgaagatcgggatcggcatcctcctgacctggctgggcctcaacagccgctccacgagcctgtccatgacctgcatcgccgtcgggatggtgaccctgtacctcggcgtgatggtccaggccgacagcgggtgcgtgatcaactggaagggccgcgagctgaagtgcgggtccggcatcttcgtgaccaacgaggtccacacgtggaccgagcagtacaagttccaggcggacagcccgaagcggctgagcgccgccatcggcaaggcctgggaggagggggtgtgcggcatccgctccgccacccggctcgagaacatcatgtggaagcagatcagcaacgagctgaaccacatcctgctcgagaacgacatgaagttcaccgtggtcgtgggggacgcgaacggcatcctggcccaggggaagaagatgatccgcccccagcccatggagcaccggtactcctggaagtcctggggcaaggccaagatcatcggcgccgacatccagaacaccacgttcatcatcgacgggcccgacaccccggagtgccccgacgaccagcgcgcgtggaacatctgggaggtggaggactacggcttcgggatcttcaccaccaacatctggctgaagctccgggactcctacacgcagatgtgcgaccaccgcctgatgagcgccgccatcaaggactccaaggccgtccacgccgacatgggctactggatcgagagcgagaagaacgagacctggaagctggcgcgggcctccttcatcgaggtgaagacctgcatctggcccaagagccacaccctctggtccaacggcgtgctggagagcgagatgatcatccccaagatctacgggggcccgatctcccagcacaactaccgccccgggtacttcacgcagaccgccggcccctggcacctggggaagctcgagctggacttcgacctgtgcgagggcaccaccgtcgtggtggacgagcactgcggcaaccgggggccgagcctccgcacgaccaccgtcaccggcaagatcatccacgagtggtgctgccggtcctgcacgctgccgcccctgcgcttccgcggggaggacggctgctggtacgggatggagatccgccccgtgaaggagcgggaggagaacctcgtcaagagcatggtctccgccggcctgggcgaggtggacagcttcagcctggggatcctctgcgtgtccatcatgatcgaggaggtcatgcgcagccggtggtcccgcaagatgctgatgaccggcaccctggccgtgttcctcctgctgatcatggggcagctcacctggaacgacctgatccgcctgtgcatcatggtgggcgcgaacgccagcgaccggatggggatgggcacgacctacctcgccctgatggccaccttcaagatgcgcccgatgttcgccgtcggcctcctcttccggcgcctgacctcccgggaggtgctgctcctgacgatcgggctgagcctcgtggcgtccgtcgagctgcccaacagcctggaggagctcggcgacgggctggccatgggcatcatgatgctgaagctcctgaccgagttccagccccaccagctgtggaccaccctcctgtccctgacgttcatcaagaccaccctcagcctggactacgcctggaagaccatggccatggtgctgtccatcgtcagcctcttccccctgtgcctgtccacgaccagccagaagaccacctggctcccggtgctgctgggctccctcgggtgcaagcccctgacgatgttcctgatcaccgagaacaagatctggggccgcaagagctggcccctcaacgaggggatcatggcgatcggcatcgtgtccatcctgctgagctccctcctgaagaacgacgtccccctggccgggccgctcatcgccggcggcatgctgatcgcctgctacgtgatcagcgggagctccgccgacctgagcctcgagaaggcggccgaggtgtcctgggaggaggaggccgagcacagcggcacctcccacaacatcctggtcgaggtgcaggacgacgggaccatgaagatcaaggacgaggagcgggacgacaccctgacgatcctcctgaaggccaccctgctcgccgtgagcggcgtctaccccatgtccatccccgcgaccctgttcgtgtggtacttctggcagaagaagaagcagcgcagcggggtgctgtgggacaccccctccccgcccgaggtcgagcgggccgtgctggacgacggcatctaccgcatcctccagcggggcctgctggggcgcagccaggtgggcgtcggggtgttccaggacggcgtgttccacacgatgtggcacgtcacccgcggggccgtgctcatgtaccagggcaagcgcctggagccctcctgggccagcgtgaagaaggacctgatctcctacggcgggggctggcggttccagggggcctggaacaccggcgaggaggtccaggtgatcgcggtggagcccgggaagaacccgaagaacgtccagaccacgcccggcaccttcaagacccccgagggcgaggtgggggccatcgccctcgacttcaagcccggcaccagcgggtccccgatcgtgaaccgcgagggcaagatcgtcggcctgtacgggaacggcgtggtgacgaccagcgggacctacgtctccgccatcgcccaggcgaagaccagccaggagggctccctgcccgagatcgaggacgaggtgttcaagaagcggaacctcacgatcatggacctgcaccccgggagcggcaagacccgccggtacctgccggccatcgtgcgcgaggccatcaagcggaagctccgcaccctgatcctggcccccacccgcgtcgtggcgagcgagatggccgaggccctcaagggcatgcccatccggtaccagacgaccgccgtgaagtccgagcacaccgggcgcgagatcgtcgacctgatgtgccacgccaccttcacgatgcggctgctcagccccgtgcgcgtgccgaactacaacatgatcatcatggacgaggcgcacttcaccgaccccgcctccatcgccgcccggggctacatcagcacccgcgtcgggatgggcgaggccgcggccatcttcatgaccgccacgccgcccgggtccgtggaggccttcccgcagagcaacgccgtgatccaggacgaggagcgggacatccccgagcgctcctggaacagcggctacgactggatcaccgacttccccggcaagaccgtctggttcgtgccctccatcaagagcgggaacgacatcgcgaactgcctgcggaagaacggcaagcgcgtgatccagctgtcccggaagaccttcgacacggagtaccagaagaccaagaacaacgactgggactacgtcgtgaccaccgacatcagcgagatgggggccaacttccgcgccgaccgggtgatcgacccgcgccggtgcctcaagcccgtcatcctgaaggacggccccgagcgcgtgatcctggccgggcccatgccggtgacggtcgcgtccgccgcccagcggcgcggccggatcggccgcaaccagaacaaggagggggaccagtacgtgtacatgggccagcccctcaacaacgacgaggaccacgcccactggaccgaggccaagatgctgctggacaacatcaacacccccgaggggatcatccccgccctcttcgagccggagcgcgagaagtccgccgccatcgacggcgagtaccggctgcgcggggaggcccggaagaccttcgtcgagctgatgcgccggggcgacctccccgtgtggctgtcctacaaggtggccagcgagggcttccagtactccgaccgccggtggtgcttcgacggggagcgcaacaaccaggtcctggaggagaacatggacgtggagatctggacgaaggagggcgagcggaagaagctccgcccccggtggctggacgcgcgcacctacagcgaccccctggccctccgggagttcaaggagttcgccgccgggcgccggtccgtgagcggcgacctgatcctggagatcggcaagctcccgcagcacctgaccctgcgcgcccagaacgcgctcgacaacctggtcatgctgcacaacagcgagcagggcgggaaggcctaccggcacgccatggaggagctccccgacaccatcgagaccctgatgctgctcgccctgatcgcggtgctgaccggcggggtgaccctcttcttcctgtccgggaaggggctgggcaagaccagcatcgggctcctgtgcgtcatggcctccagcgccctgctctggatggcctccgtggagccccactggatcgccgcgagcatcatcctggagttcttcctgatggtgctcctgatccccgagccggaccgccagcggacgccccaggacaaccagctggcctacgtcgtgatcggcctcctgttcatgatcctgacggtggccgccaacgagatggggctcctggagaccaccaagaaggacctgggcatcgggtacgtcgccgcggagaaccaccaccacgccaccatgctcgacgtggacctgcgccccgcctccgcctggacgctgtacgccgtggcgaccaccgtcatcaccccgatgatgcggcacacgatcgagaacaccaccgccaacatcagcctcaccgccatcgccaaccaggccgcgatcctgatgggcctggacaagggctggcccatctccaagatggacatcggggtgcccctcctggccctgggctgctacagccaggtgaaccccctcacgctgaccgccgccgtcctgatgctcgtggcgcactacgccatcatcgggccgggcctgcaggccaaggccacccgcgaggcccagaagcgcaccgcggccgggatcatgaagaaccccacggtggacggcatcgtcgccatcgacctggaccccgtggtgtacgacgccaagttcgagaagcagctcggccagatcatgctgctgatcctctgcacctcccagatcctgctgatgcggaccacctgggccctctgcgagagcatcacgctggcgaccgggcccctgaccaccctctgggagggctccccggggaagttctggaacacgaccatcgccgtcagcatggccaacatcttccgcggctcctacctggccggcgccgggctggcgttcagcctcatgaagtccctgggcgggggccggcgcgggaccggcgcccagggcgagaccctgggggagaagtggaagcggcagctcaaccagctgagcaagtccgagttcaacacgtacaagcgcagcggcatcatggaggtggaccggagcgaggccaaggaggggctgaagcgcggcgagaccaccaagcacgccgtgtcccgggggaccgcgaagctgcgctggttcgtcgagcggaacctcgtgaagcccgagggcaaggtgatcgacctgggctgcgggcgcggcgggtggagctactactgcgccggcctgaagaaggtcacggaggtgaaggggtacaccaagggcggccccgggcacgaggagcccatcccgatggccacctacggctggaacctcgtgaagctgcactccgggaaggacgtcttcttcacgccgcccgagaagtgcgacaccctgctctgcgacatcggcgagagctcccccaacccgacgatcgaggaggggcggaccctgcgcgtgctgaagatggtggagccctggctccggggcaaccagttctgcatcaagatcctgaacccctacatgcccagcgtcgtggagaccctggagcagatgcagcgcaagcacggcgggatgctcgtgcggaacccgctgtcccgcaacagcacccacgagatgtactgggtctcctgcggcacggggaacatcgtgagcgccgtgaacatgacctcccggatgctgctcaaccgcttcaccatggcccaccgcaagcccacctacgagcgggacgtcgacctgggcgcgggcacgcgccacgtggccgtggagcccgaggtcgccaacctggacatcatcgggcagcggatcgagaacatcaagaacgagcacaagagcacctggcactacgacgaggacaacccctacaagacctgggcctaccacggctcctacgaggtgaagccgagcgggtccgccagctccatggtgaacggcgtcgtgcgcctcctgaccaagccctgggacgtcatccccatggtgacgcagatcgcgatgaccgacaccacccccttcgggcagcagcgggtgttcaaggagaaggtcgacacgcgcaccccgcgggccaagcgcggcaccgcccagatcatggaggtgaccgccaagtggctgtggggcttcctcagccggaacaagaagccccgcatctgcacgcgggaggagttcacccgcaaggtgcggtccaacgccgcgatcggggccgtcttcgtggacgagaaccagtggaacagcgccaaggaggccgtggaggacgagcgcttctgggacctggtccaccgggagcgcgagctgcacaagcagggcaagtgcgcgacctgcgtgtacaacatgatggggaagcgggagaagaagctcggcgagttcgggaaggccaagggcagccgcgccatctggtacatgtggctgggcgcccggttcctggagttcgaggccctcgggttcatgaacgaggaccactggttctcccgcgagaacagcttctccggcgtggagggggagggcctgcacaagctggggtacatcctccgggacatcagcaagatccccggcggcaacatgtacgcggacgacaccgccgggtgggacacgcgcatcaccgaggacgacctgcagaacgaggccaagatcaccgacatcatggagccggagcacgccctgctcgccacctccatcttcaagctgacgtaccagaacaaggtcgtgcgcgtgcagcggcccgcgaagaacggcaccgtcatggacgtgatcagccgccgggaccagcgcgggtccggccaggtgggcacctacgggctgaacaccttcacgaacatggaggtccagctcatccggcagatggagagcgagggcatcttcctgccctccgagctggagacccccaacctcgccgagcgcgtgctggactggctggagaagcacgggaccgagcggctcaagcgcatggccatcagcggcgacgactgcgtggtcaagccggtggacgaccggttcgccaccgccctgatcgcgctgaacgacatggggaaggtgcgcaaggacatcccccagtgggagccctccaagggctggaacgactggcagcaggtccccttctgcagccaccacttccaccagctcatcatgaaggacggccgggagatcgtggtgccgtgccgcaaccaggacgagctggtcgggcgggcccgcgtgtcccagggcgccgggtggagcctgcgggagacggcctgcctcggcaagtcctacgcccagatgtggcagctgatgtacttccaccgccgggacctgcgcctcgcggccaacgccatctgcagcgccgtgcccgtcgactgggtgcccacctcccggaccacctggagcatccacgcgcaccaccagtggatgaccacggaggacatgctgagcgtgtggaaccgcgtctggatcgaggagaacccctggatggaggacaagacccacgtgtccagctgggaggaggtgccgtacctggggaagcgcgaggaccagtggtgcggctccctcatcggcctgaccgcccgggccacctgggccacgaacatccaggtcgccatcaaccaggtgcgccggctgatcgggaacgagaactacctcgactacatgaccagcatgaagcgcttcaagaacgagtccgaccccgagggcgcgctgtggtga

SEQ ID NO: 8220 - RNA, 9879 nt, synthetic construct
  misc_feature 1..9879: note = derived and/or modified CDS sequence (opt1) from DENV-1__FJ410185__SS-prME
  source 1..9879: mol_type = other RNA
agcgtgaccatgctgctcatgctgctgcccaccgccctcgccttccacctgaccacccggggcggggagccccacatgatcgtcagcaagcaggagcggggcaagagcctgctgttcaagaccagcgtggggatcaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgggacaagcggtccgtggccctggcgccccacgtgggcctggggctcgagacgcggaccgagacctggatgagctccgagggcgcctggaagcagatccagaaggtcgagacctgggccctgcggcacccggggttcaccgtgatcgccctgttcctcgcccacgcgatcggcaccagcatcacccagaaggggatcatcttcatcctgctgatgctcgtgaccccctccatggccatgcggtgcgtcggcatcggcaaccgggacttcgtggaggggctgagcggcgccacgtgggtggacgtcgtgctggagcacgggtcctgcgtgaccaccatggccaaggacaagcccaccctcgacatcgagctgctgaagacggaggtcaccaaccccgccgtgctccgcaagctgtgcatcgaggcgaagatcagcaacaccaccacggactcccggtgcccgacccagggcgaggccaccctggtggaggagcaggacagcaacttcgtctgccgccggaccttcgtggaccgcggctgggggaacggctgcggcctcttcggcaaggggtccctgctgacgtgcgccaagttcaagtgcgtgaccaagctcgagggcaagatcgtccagtacgagaacctgaagtacagcgtgatcgtgaccgtccacaccggcgaccagcaccaggtggggaacgagacgaccgagcacggcaccatcgccaccatcacgccccaggcccccacgtccgagatccagctgaccgactacggggcgctcaccctggactgcagcccccggaccggcctggacttcaacgagatggtcctcctgacgatgaaggagaagtcctggctggtgcacaagcagtggttcctcgacctgccgctgccctggaccagcggggccagcacctcccaggagacctggaaccgccaggacctcctggtgacgttcaagaccgcccacgccaagaagcaggaggtcgtggtgctgggcagccaggagggcgccatgcacaccgcgctcaccggggccacggagatccagacctccggcaccaccacgatcttcgccgggcacctgaagtgccggctgaagatggacaagctcaccctgaagggcatgagctacgtcatgtgcaccgggtccttcaagctggagaaggaggtggccgagacccagcacggcacggtgctggtccaggtgaagtacgagggcaccgacgccccctgcaagatccccttcagcgcgcaggacgagaagggggtgacccagaacggccgcctcatcaccgccaacccgatcgtcacggacaaggagaagcccgtgaacatcgagaccgagccgcccttcggggagtcctacatcgtgatcggcgccggcgagaaggccctgaagctgagctggttcaagaaggggtccagcatcggcaagatgttcgaggcgaccgcccgcggggcccgccggatggccatcctcggcgacaccgcctgggacttcgggtccatcggcggcgtcttcacgagcgtggggaagctggtgcaccaggtcttcggcgcggcctacggggtgctgttctccggcgtgagctggaccatgaagatcgggatcggcatcctcctgacctggctgggcctcaactcccgcagcacctccctgagcatgacgtgcatcgccgtcgggatggtgaccctgtacctcggcgtgatggtccaggccgactccgggtgcgtgatcaactggaagggccgcgagctgaagtgcgggagcggcatcttcgtgaccaacgaggtccacacctggacggagcagtacaagttccaggccgacagcccgaagcggctgtccgcggccatcggcaaggcctgggaggagggggtgtgcggcatccgcagcgccacccggctcgagaacatcatgtggaagcagatctccaacgagctgaaccacatcctgctcgagaacgacatgaagttcaccgtggtcgtgggggacgccaacggcatcctggcgcaggggaagaagatgatccgcccccagcccatggagcaccggtacagctggaagtcctggggcaaggccaagatcatcggcgccgacatccagaacaccaccttcatcatcgacgggcccgacacgccggagtgccccgacgaccagcgcgcctggaacatctgggaggtggaggactacggcttcgggatcttcaccaccaacatctggctgaagctccgggacagctacacccagatgtgcgaccaccgcctgatgtccgcggccatcaaggacagcaaggccgtccacgccgacatgggctactggatcgagtccgagaagaacgagacgtggaagctggcccgggcgagcttcatcgaggtgaagacctgcatctggcccaagtcccacaccctctggagcaacggcgtgctggagtccgagatgatcatccccaagatctacgggggcccgatcagccagcacaactaccgccccgggtacttcacccagacggccggcccctggcacctggggaagctcgagctggacttcgacctgtgcgagggcaccaccgtcgtggtggacgagcactgcggcaaccgggggccgtccctccgcaccacgaccgtcaccggcaagatcatccacgagtggtgctgccggagctgcaccctgccgcccctgcgcttccgcggggaggacggctgctggtacgggatggagatccgccccgtgaaggagaaggaggagaacctcgtgcggtccatggtcagcgccggcagcggcgaggtggactccttcagcctggggatcctgtgcgtgtccatcatgatcgaggaggtcatgcgcagccggtggtcccgcaagatgctcatgacgggcaccctggccgtgttcctgctcctgatcatggggcagctgacctggaacgacctcatccgcctgtgcatcatggtgggcgccaacgcgagcgaccggatggggatgggcaccacgtacctggccctcatggccaccttcaagatgcgcccgatgttcgccgtcggcctgctgttccggcgcctcacctcccgggaggtgctgctgctcaccatcgggctgagcctggtggcctccgtcgagctccccaacagcctggaggagctgggcgacgggctcgcgatgggcatcatgatgctgaagctgctcacggagttccagccccaccagctgtggaccaccctgctctccctgaccttcatcaagacgaccctgagcctcgactacgcctggcgcaccatggccatggtgctgtccatcgtcagcctgttccccctctgcctgtccaccacgagccagaagaccacctggctgccggtgctcctgggctccttcgggtgcaagcccctgaccatgttcctcatcacggagaacaagatctggggccgcaagagctggcccctgaacgaggggatcatggccatcggcatcgtgtccatcctgctcagcagcctgctgaagaacgacgtccccctcgcggggccgctgatcgccggcggcatgctgatcgcctgctacgtgatctccgggagctccgccgacctcagcctggagaaggccgcggaggtgtcctgggaggaggaggccgagcacagcggcacctcccacaacatcctggtcgaggtgcaggacgacgggaccatgaagatcaaggacgaggagcgcgacgacaccctcaccatcctgctgaaggccacgctcctggccgtgagcggcgtctaccccatgtccatccccgccaccctgttcgtgtggtacttctggcagaagaagaagcagcggagcggggtgctctgggacaccccctccccgcccgaggtcgagcgcgcggtgctggacgacggcatctaccggatcctgcagcgcggcctgctcgggcggagccaggtgggcgtcggggtgttccaggacggcgtgttccacaccatgtggcacgtcacgcgcggggccgtgctgatgtaccagggcaagcggctggagccctcctgggccagcgtgaagaaggacctcatctcctacggcgggggctggcgcttccaggggagctggaacaccggcgaggaggtccaggtgatcgccgtggagcccgggaagaacccgaagaacgtccagaccacccccggcacgttcaagacccccgagggcgaggtgggggccatcgcgctggacttcaagcccggcacctccgggagcccgatcgtgaaccgggaggagaagatcgtcggcctgtacggcaacggggtggtgaccacgtccggcacctacgtcagcgccatcgcccaggccaagaccagccaggaggggcccctccccgagatcgaggacgaggtgttcaagaagcgcaacctgaccatcatggacctgcacccgggctccgggaagacgcggcgctacctccccgccatcgtgcgggaggcgatcaagcgcaagctgcgcaccctgatcctcgcccccacccgggtcgtggccagcgagatggccgaggcgctgaagggcatgcccatccgctaccagaccacggccgtgaagtccgagcacaccggccgggagatcgtcgacctgatgtgccacgccaccttcaccatgcgcctcctgagcccggtgcgggtgcccaactacaacatgatcatcatggacgaggcccacttcacggaccccgcctccatcgcggcccgcgggtacatcagcacccgggtcggcatgggggaggccgccgccatcttcatgaccgcgacgccgcccggctccgtggaggccttcccccagagcaacgccgtgatccaggacgaggagcgcgacatccccgagcggtcctggaacagcgggtacgactggatcacggacttccccggcaagaccgtctggttcgtgccctccatcaagagcggcaacgacatcgccaactgcctgcgcaagaacgggaagcgggtgatccagctctcccgcaagaccttcgacaccgagtaccagaagacgaagaacaacgactgggactacgtcgtgaccaccgacatcagcgagatgggcgccaacttccgggcggaccgcgtgatcgacccccggcgctgcctgaagcccgtcatcctgaaggacgggcccgagcgggtgatcctcgccggcccgatgcccgtgaccgtcgcctccgccgcgcagcgccgggggcgcatcggccgcaaccagaacaaggagggcgaccagtacgtgtacatggggcagcccctgaacaacgacgaggaccacgcccactggacggaggccaagatgctgctcgacaacatcaacacccccgagggcatcatcccggccctgttcgagcccgagcgggagaagtccgccgcgatcgacggggagtaccgcctgcggggcgaggcccgcaagaccttcgtcgagctcatgcggcgcggggacctgcccgtgtggctgtcctacaaggtggccagcgagggcttccagtactccgaccggcgctggtgcttcgacggcgagcggaacaaccaggtcctcgaggagaacatggacgtggagatctggaccaaggagggggagcgcaagaagctgcggccccgctggctggacgcccggacgtacagcgacccgctcgccctgcgcgagttcaaggagttcgcggccggccggcgcagcgtgtccggggacctgatcctcgagatcggcaagctgccccagcacctgaccctccgggcccagaacgccctggacaacctggtcatgctccacaacagcgagcagggcgggaaggcctaccgccacgcgatggaggagctgcccgacaccatcgagaccctgatgctcctggccctgatcgccgtgctcaccggcggggtgacgctgttcttcctgtccggcaaggggctcggcaagaccagcatcggcctgctgtgcgtcatggcctccagcgcgctcctgtggatggccaacgtggagccccactggatcgccgcctccatcatcctggagttcttcctcatggtgctgctgatcccggagcccgaccggcagcgcacgccccaggacaaccagctcgcctacgtcgtgatcgggctgctgttcatgatcctcaccgtggcggccaacgagatgggcctgctggagacgaccaagaaggacctcgggatcggccacgtcgccgccgagaaccagcaccacgccaccatgctggacgtggacctgcggccggcgagcgcctggaccctctacgccgtggccacgaccgtcatcacccccatgatgcgccacaccatcgagaacacgaccgccaacatctccctgaccgcgatcgccaaccaggccgccatcctgatggggctcgacaagggctggcccatcagcaagatggacatcggcgtgcccctgctggccctcgggtgctactcccaggtgaacccgctgaccctgacggcggccgtcctcatgctggtggcccactacgccatcatcggccccgggctgcaggcgaaggccacccgcgaggcccagaagcggaccgccgccggcatcatgaagaaccccaccgtggacgggatcgtcgcgatcgacctcgaccccgtggtgtacgacgccaagttcgagaagcagctgggccagatcatgctgctcatcctgtgcacgagccagatcctgctcatgcgcaccacctgggccctgtgcgagtccatcaccctggccacgggcccgctcaccaccctgtgggaggggagccccggcaagttctggaacaccacgatcgccgtctccatggcgaacatcttccgggggagctacctggccggcgccggcctcgccttctccctgatgaagtccctcgggggcgggcgccgggggaccggggcccagggcgagaccctcggcgagaagtggaagcgccagctgaaccagctgtccaagagcgagttcaacacctacaagcggagcgggatcatggaggtggaccgctccgaggcgaaggagggcctcaagcgcggggagacgaccaagcacgccgtgagccgcggcaccgccaagctgcggtggttcgtcgagcgcaacctggtgaagcccgaggggaaggtgatcgacctgggctgcggccgcggcgggtggtcctactactgcgccgggctcaagaaggtcaccgaggtgaaggggtacacgaagggcgggcccggccacgaggagccgatccccatggcgacctacgggtggaacctggtgaagctgtacagcggcaaggacgtcttcttcacgccgcccgagaagtgcgacaccctcctgtgcgacatcggggagtccagcccgaaccccaccatcgaggagggccgcacgctgcgggtgctcaagatggtggagccctggctgcgcgggaaccagttctgcatcaagatcctgaacccctacatgccgtccgtcgtggagaccctcgagcagatgcagcggaagcacggcggcatgctggtgcgcaaccccctgagccggaactccacccacgagatgtactgggtcagctgcgggaccggcaacatcgtgtccgccgtgaacatgacgagccgcatgctcctgaaccgcttcaccatggcccaccggaagcccacctacgagcgcgacgtcgacctgggggccggcacccggcacgtggccgtggagcccgaggtcgcgaacctcgacatcatcggccagcgcatcgagaacatcaagaacgagcacaagtccacgtggcactacgacgaggacaacccgtacaagacctgggcctaccacgggagctacgaggtgaagccctccggcagcgcctccagcatggtgaacggggtcgtgcggctgctgaccaagccctgggacgtcatccccatggtgacccagatcgccatgacggacaccaccccgttcggccagcagcgcgtgttcaaggagaaggtcgacacccggacgccccgcgccaagcgggggaccgcgcagatcatggaggtgaccgccaagtggctctggggcttcctgtcccgcaacaagaagccccggatctgcacccgcgaggagttcacgcggaaggtgcgcagcaacgccgccatcggcgccgtcttcgtggacgagaaccagtggaacagcgcgaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggtcccgggcgatctggtacatgtggctgggcgcccgcttcctcgagttcgaggccctgggcttcatgaacgaggaccactggttcagccgggagaactccttcagcggggtggagggcgaggggctgcacaagctcggctacatcctgcgcgacatctccaagatccccgggggcaacatgtacgccgacgacaccgccggctgggacacccgcatcacggaggacgacctgcagaacgaggcgaagatcaccgacatcatggagcccgagcacgccctcctggccaccagcatcttcaagctgacctaccagaacaaggtcgtgcgggtgcagcgccccgccaagaacgggacggtcatggacgtgatctcccggcgcgaccagcggggcagcggccaggtggggacctacggcctcaacaccttcaccaacatggaggtccagctgatccgccagatggagtccgaggggatcttcctgcccagcgagctcgagacgccgaacctggccgagcgggtgctggactggctcgagaagcacggcaccgagcgcctgaagcggatggcgatctccggggacgactgcgtggtcaagcccgtggacgaccgcttcgccaccgccctgatcgccctcaacgacatgggcaaggtgcggaaggacatcccccagtgggagcccagcaaggggtggaacgactggcagcaggtcccgttctgctcccaccacttccaccagctgatcatgaaggacggccgcgagatcgtggtgccctgccggaaccaggacgagctggtcggccgcgcccgggtgagccagggggcgggctggtccctccgcgagaccgcctgcctgggcaagagctacgcccagatgtggcagctgatgtacttccaccggcgcgacctccggctggccgccaacgcgatctgctccgccgtgcccgtcgactgggtgcccacgagccgcaccacctggagcatccacgcccaccaccagtggatgaccaccgaggacatgctgtccgtgtggaaccgcgtctggatcgaggagaacccgtggatggaggacaagacgcacgtgagctcctgggaggaggtgccctacctcggcaagcgggaggaccagtggtgcgggagcctgatcggcctgaccgcccgcgcgacctgggccaccaacatccaggtcgccatcaaccaggtgcggcgcctcatcggcaacgagaactacctggactacatgacgtccatgaagcggttcaagaacgagagcgaccccgagggggccctgtggtga

SEQ ID NO: 8221 - RNA, 9879 nt, synthetic construct
  misc_feature 1..9879: note = derived and/or modified CDS sequence (opt1) from DENV-1__FJ547087__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctcatcacggccaacccgatcgtcaccgacaaggagaagcccgtgaacatcgagaccgagccgcccttcggggagagctacatcatggtgggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtcttcacctccgtggggaagctggtgcaccaggtcttcggcaccgcctacggggtgctgttcagcggcgtgtcctggaccatgaagatcgggatcggcatcctcctgacgtggctgggcctcaacagccgctccgccagcctgtccatgacctgcatcgccgtcgggatggtgaccctgtacctcggcgtgatggtccaggccgacagcgggtgcgtgatcaactggaagggccgcgagctgaagtgcgggtccggcatcttcgtgaccaacgaggtccacacgtggaccgagcagtacaagttccaggcggacagcccgaagcggctgagcgccgccatcggcaaggcctgggaggagggggtgtgcggcatccgctccgccacccggctcgagaacatcatgtggaagcagatcagcaacgagctgaaccacatcctgctcgagaacgacatgaagttcaccgtggtcgtgggggacgcgaacggcatcctggcccaggggaagaagatgatccgcccccagcccatggagcacaagtactcctggaagtcctggggcaaggccaagatcatcggcgccgacatccagaacaccacgttcatcatcgacgggcccgacaccccggagtgccccgacgaccagcgggcgtggaacatctgggaggtggaggactacggcttcgggatcttcaccaccaacatctggctgaagctccgcgactcctacacgcagatgtgcgaccaccggctgatgagcgccgccatcaaggactccaaggccgtccacgccgacatgggctactggatcgagagcgagaagaacgagacctggaagctggcgcgcgcctccttcatcgaggtgaagacctgcatctggcccaagagccacaccctctggtccaacggcgtgctggagagcgagatgatcatccccaagatctacgggggcccgatctcccagcacaactaccggcccgggtacttcacgcagaccgccggcccctggcacctggggaagctcgagctggacttcgacctgtgcgagggcaccaccgtcgtggtggacgagcactgcggcaaccgcgggccgagcctccggacgaccaccgtcaccggcaagatcatccacgagtggtgctgccgctcctgcacgctgccgcccctgcggttccgcggggaggacggctgctggtacgggatggagatccggcccgtgaaggagaaggaggagaacctcgtgcgcagcatggtctccgccggcagcggcgaggtggacagcttctccctggggatcctgtgcgtgagcatcatgatcgaggaggtcatgcggtcccgctggagccggaagatgctcatgaccggcaccctggccgtgttcctgctcctgatcatggggcagctgacctggaacgacctcatccgcctgtgcatcatggtgggcgcgaacgcctccgaccgcatggggatgggcacgacctacctggccctcatggccaccttcaagatgcggccgatgttcgccgtcgggctgctgttccgccggctcaccagccgcgaggtgctgctgctcacgatcgggctgtccctggtggcgagcgtcgagctccccaactccctggaggagctgggcgacgggctcgccatgggcatcatgatgctgaagctgctcaccgagttccagccccaccagctgtggaccaccctgctcagcctgacgttcatcaagaccaccctgtccctcgactacgcctggaagaccatggccatggtgctgagcatcgtctccctgttccccctctgcctgagcacgacctcccagaagaccacctggctgccggtgctcctgggcagcttcgggtgcaagcccctgacgatgttcctcatcaccgagaacaagatctggggccggaagtcctggcccctgaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggaggaggaggccgagcactccggcaccagccacaacatcctggtcgaggtgcaggacgacgggaccatgaagatcaaggacgaggagcgcgacgacaccctcacgatcctgctgaaggccaccctcctggccgtgtccggcgtctaccccatgagcatccccgcgaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacacgatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcaccagcgggtccccgatcgtgaaccgggagggcaagatcgtcggcctgtacgggaacggcgtggtgacgaccagcgggacctacgtctccgccatcgcccaggccaaggcgagccaggacggccccctccccgagatcgaggacgaggtgttcaagaagcgcaacctgaccatcatggacctgcacccggggagcggcaagacgcggcgctacctccccgccatcgtgcgggaggccatcaagcgcaagctgcggaccctgatcctcgcccccacccgcgtcgtggcgtccgagatggccgaggccctgaagggcatgcccatccgctaccagaccacggccgtcaagagcgagcacaccgggcgggagatcgtcgacctgatgtgccacgccaccttcaccatgcgcctcctgtccccggtgcgggtgcccaactacaacatgatcatcatggacgaggcgcacttcacggaccccgccagcatcgccgcccgcggctacatctccacccgggtcgggatgggcgaggccgcggccatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgcgaactgcctgcgcaagaacggcaagcgggtgatccagctcagccgcaagaccttcgacaccgagtaccagaagacgaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgccgggccgatgcccgtgaccgtcgcgagcgccgcccagcgccggggccgcatcggccggaaccagaacaaggagggggaccagtacgtgtacatgggccagcccctgaacaacgacgaggaccacgcccactggacggaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtggcctccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcgcggacgtactccgacccgctcgccctgcgcgagttcaaggagttcgccgccgggcggcgcagcgtgagcggcgacctgatcctcgagatcggcaagctgccccagcacctgaccatccgggcccagaacgcgctcgacaacctggtcatgctgcacaactccgagcagggcgggaaggcctaccgccacgccatggaggagctccccgacaccatcgagaccctgatgctgctcgccctgatcgcggtgctgaccgggggcgtgaccctcttcttcctgagcgggaagggcctgggcaagacctccatcgggctcctgtgcgtcatggccagctccgccctgctctggatggccagcgtggagccccactggatcgccgcgtccatcatcctggagttcttcctgatggtgctcctgatcccggagcccgaccggcagcgcacgccccaggacaaccagctggcctacgtcgtgatcggcctcctgttcatgatcctgaccgtggccgccaacgagatggggctcctggagacgaccaagaaggacctgggcatcgggcacgtcgccgcggagaaccaccaccacgccaccatgctcgacgtggacctgcggccggccagcgcctggaccctgtacgccgtggcgacgaccgtcatcacccccatgatgcgccacaccatcgagaacacgaccgccaacatctccctcaccgccatcgccaaccaggccgcgatcctgatgggcctggacaagggctggcccatcagcaagatggacatcggggtgcccctcctggccctgggctgctactcccaggtgaacccgctcaccctgacggccgccgtcctgatgctcgtggcgcactacgccatcatcgggcccggcctgcaggccaaggccacccgggaggcccagaagcgcaccgcggccgggatcatgaagaaccccaccgtggacggcatcgtcgccatcgacctggaccccgtggtgtacgacgccaagttcgagaagcagctcggccagatcatgctgctgatcctctgcacgagccagatcctgctgatgcgcaccacctgggccctctgcgagtccatcaccctggcgacggggccgctgaccaccctctgggagggcagccccgggaagttctggaacaccacgatcgccgtctccatggccaacatcttccggggcagctacctggccggcgccgggctggcgttctccctcatgaagtccctgggcgggggccgccgggggaccggcgcccagggcgagaccctgggggagaagtggaagcgccagctcaaccagctgtccaagagcgagttcaacacctacaagcggagcggcatcatggaggtggaccgctccgaggccaaggaggggctgaagcggggcgagacgaccaagcacgccgtgagccgcgggaccgcgaagctccggtggttcgtcgagcgcaacctggtgaagcccgagggcaaggtgatcgacctgggctgcgggcggggcgggtggtcctactactgcgccggcctgaagaaggtcaccgaggtgaaggggtacacgaagggcggccccgggcacgaggagccgatccccatggccacctacggctggaacctcgtgaagctgcacagcgggaaggacgtcttcttcacgccgcccgagaagtgcgacaccctgctctgcgacatcggcgagtccagcccgaaccccaccatcgaggaggggcgcacgctgcgggtgctgaagatggtggagccctggctccgcggcaaccagttctgcatcaagatcctgaacccctacatgccgtccgtcgtggagaccctggagcagatgcagcggaagcacggcgggatgctcgtgcgcaaccccctgagccggaactccacccacgagatgtactgggtcagctgcggcaccgggaacatcgtgtccgccgtgaacatgacgagccgcatgctgctcaaccggttcaccatggcccaccgcaagcccacctacgagcgcgacgtcgacctgggcgcgggcacccggcacgtggccgtggagcccgaggtcgccaacctggacatcatcgggcagcgcatcgagaacatcaagaacgagcacaagtccacgtggcactacgacgaggacaacccgtacaagacctgggcctaccacggcagctacgaggtgaagccctccgggagcgcctccagcatggtgaacggcgtcgtgcggctcctgaccaagccctgggacgtcatccccatggtgacccagatcgcgatgacggacaccaccccgttcgggcagcagcgcgtgttcaaggagaaggtcgacacccggacgccccgcgccaagcggggcaccgcccagatcatggaggtgaccgccaagtggctgtggggcttcctctcccgcaacaagaagccccggatctgcacccgcgaggagttcacgcggaaggtgcgcagcaacgccgcgatcggggccgtcttcgtggacgagaaccagtggaacagcgccaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggctcccgggccatctggtacatgtggctgggcgcccgcttcctggagttcgaggccctcgggttcatgaacgaggaccactggttcagccgggagaactccctgagcggcgtggagggggagggcctgcacaagctcgggtacatcctgcgcgacatctccaagatcccgggcggcaacatgtacgcggacgacaccgccgggtgggacacccggatcacggaggacgacctgcagaacgaggccaagatcaccgacatcatggagcccgagcacgccctcctggccaccagcatcttcaagctgacctaccagaacaaggtcgtgcgcgtgcagcgccccgcgaagaacggcacggtcatggacgtgatctcccggcgcgaccagcgggggagcggccaggtgggcacctacgggctcaacaccttcaccaacatggaggtccagctgatccgccagatggagtccgagggcatcttcctgccctgcgagctcgagacgccgaacctggccgagcgggtgctggactggctcgagaagcacggggccgagcgcctgaagcggatggccatcagcggcgacgactgcgtggtcaagcccatcgacgaccgcttcgccaccgcgctgatcgccctcaacgacatggggaaggtgcggaaggacatcccccagtgggagccctccaagggctggaacgactggcagcaggtcccgttctgcagccaccacttccaccagctgatcatgaaggacggccgcgagatcgtcgtgccctgccggaaccaggacgagctggtggggcgcgcccgggtctcccagggcgccgggtggagcctccgcgagaccgcctgcctgggcaagtcctacgcgcagatgtggcagctgatgtacttccaccggcgcgacctccggctggccgccaacgccatctgcagcgcggtgcccgtggactgggtccccacctcccgcacgacctggagcatccacgcccaccaccagtggatgaccaccgaggacatgctgagcgtgtggaaccgggtgtggatcgaggagaacccgtggatggaggacaagacccacgtctccagctgggaggaggtgccctacctcgggaagcgcgaggaccagtggtgcggctccctgatcggcctgacggcccgcgccacctgggccaccaacatccaggtggcgatcaaccaggtccggcgcctcatcgggaacgagaactacctggactacatgaccagcatgaagcggttcaagaacgagtccgaccccgagggcgccctgtggtga

SEQ ID NO: 8222 - RNA, 9879 nt, synthetic construct
  misc_feature 1..9879: note = derived and/or modified CDS sequence (opt1) from DENV-1__FJ410186__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgccggggtgaacatgtgcaccctgatcgccatggacctgggcgagctctgcgaggacaccatgacctacaagtgcccccggatcaccgaggtggagcccgacgacgtggactgctggtgcaacgccaccgacacctgggtgacctacgggacctgcagccagaccggcgagcaccggcgcgacaagcggtccgtggccctggcgccccacgtcggcctggggctcgagacgcgcaccgagacctggatgagctccgagggcgcctggaagcagatccagaaggtggagacctgggccctgcggcaccccgggttcacggtgatcgccttcttcctggcccacgcgatcggcaccagcatcacccagaaggggatcatcttcatcctcctgatgctggtgaccccctccatggccatgcgctgcgtgggcatcggcaaccgggacttcgtggaggggctcagcggcgccacgtgggtcgacgtggtgctggagcacgggtcctgcgtcaccaccatggccaagaacaagcccaccctggacatcgagctcctgaagacggaggtgaccaaccccgccgtgctgcgcaagctctgcatcgaggcgaagatcagcaacaccaccacggactcccggtgccccacccagggcgaggccaccctggtcgaggagcaggacgccaacttcgtgtgccgccggaccttcgtggaccgcggctgggggaacggctgcgggctgttcggcaaggggagcctcctgacgtgcgccaagttcaagtgcgtcaccaagctggagggcaagatcgtgcagtacgagaacctcaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctgaccctcgactgcagcccccggaccggcctggacttcaacgagatggtgctgctcacgatgaaggagaagtcctggctggtgcacaagcagtggttcctggacctcccgctgccctggacctccggggccagcaccagccaggagacctggaaccgccaggacctgctcgtcacgttcaagaccgcccacgccaagaagcaggaggtggtggtcctgggctcccaggagggcgcgatgcacaccgccctgaccggggccacggagatccagaccagcggcaccaccacgatcttcgccgggcacctcaagtgccggctgaagatggacaagctgaccctcaagggcatgtcctacgtgatgtgcaccgggagcttcaagctggagaaggaggtggccgagacccagcacggcacggtcctggtccaggtgaagtacgagggcaccgacgcgccctgcaagatccccttctccacccaggacgagaagggggtcacccagaacggccgcctgatcacggccaacccgatcgtgaccgacaaggagaagcccgtgaacatcgagaccgagccgcccttcggggagagctacatcatcgtcggcgccggcgagaaggccctcaagctgtcctggttcaagaaggggagctccatcggcaagatgttcgaggcgaccgcccgcggggcccgccggatggccatcctgggcgacacggcctgggacttcgggagcatcggcggcgtgttcacctccgtggggaagctcgtccaccaggtgttcggcaccgcgtacggggtgctgttcagcggcgtctcctggaccatgaagatcgggatcggcatcctgctcacgtggctgggcctgaacagccgctccgccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcaccaacgaggtgcacacgtggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacaccacgttcatcatcgacgggcccgacaccccggagtgccccgacgaccagcgggcctggaacatctgggaggtcgaggactacggcttcgggatcttcaccaccaacatctggctgaagctgcgcgactcctacacgcagatgtgcgaccaccggctcatgagcgcggccatcaaggactccaaggccgtgcacgccgacatgggctactggatcgagagcgagaagaacgagacctggaagctggcccgcgcgtccttcatcgaggtgaagacctgcatctggcccaagagccacaccctgtggtccaacggcgtcctcgagagcgagatgatcatccccaagatctacgggggcccgacgtcccagcacaactaccggcccgggtacttcacccagaccgccggcccctggcacctggggaagctggagctcgacttcgacctgtgcgagggcaccacggtggtggtcgacgagcactgcggcaaccgcgggccgagcctgcggaccaccaccgtgacgggcaagatcatccacgagtggtgctgccgctcctgcaccctgccgcccctgcggttccgcggggaggacggctgctggtacgggatggagatccggcccgtgaaggagaaggaggagaacctggtccgcagcatggtgtccgccggcagcggcgaggtggacagcttctccctcgggatcctgtgcgtcagcatcatgatcgaggaggtgatgcggtcccgctggagccggaagatgctgatgaccggcaccctcgccgtgttcctgctgctcatcatggggcagctgacgtggaacgacctgatccgcctctgcatcatggtcggcgccaacgcgtccgaccgcatggggatgggcaccacctacctggccctgatggccaccttcaagatgcggccgatgttcgccgtgggcctcctgttccgccggctgacgagccgcgaggtgctcctgctgaccatcgggctctccctggtcgccagcgtggagctgcccaactccctcgaggagctgggcgacgggctggcgatgggcatcatgatgctcaagctgctgaccgagttccagccccaccagctctggaccacgctgctgagcctcaccttcatcaagaccaccctgtccctggactacgcctggaagacgatggccatggtcctcagcatcgtgtccctgttccccctgtgcctcagcaccacctcccagaagaccacgtggctgccggtgctgctcggcagcttcgggtgcaagcccctgaccatgttcctgatcaccgagaacaagatctggggccggaagtcctggcccctcaacgaggggatcatggccatcggcatcgtcagcatcctgctgtccagcctcctgaagaacgacgtgcccctggcggggccgctcatcgccggcggcatgctgatcgcctgctacgtgatcagcgggtccagcgccgacctgtccctcgagaaggccgcggaggtcagctgggaggaggaggccgagcactccggcaccagccacaacatcctggtggaggtgcaggacgacgggaccatgaagatcaaggacgaggagcgcgacgacacgctgaccatcctcctgaaggccaccctgctcgccgtctccggcgtgtaccccatgagcatccccgccaccctgttcgtgtggtacttctggcagaagaagaagcagcggtccggggtcctgtgggacacgcccagcccgcccgaggtggagcgcgcggtgctcgacgacggcatctaccggatcctgcagcgcggcctgctggggcggtcccaggtcggcgtgggggtgttccaggacggcgtcttccacaccatgtggcacgtgacccgcggggccgtgctcatgtaccagggcaagcggctggagcccagctgggcctccgtcaagaaggacctgatcagctacggcgggggctggcgcttccaggggctctggaacaccggcgaggaggtccaggtgatcgccgtcgagcccgggaagaacccgaagaacgtgcagacgacccccggcaccttcaagacccccgagggcgaggtgggggccatcgcgctggacttcaagcccggcacgtccgggagcccgatcgtcaaccgggagggcaagatcgtgggcctgtacgggaacggcgtggtcaccacctccgggacctacgtgagcgccatcgcccaggccaaggcctcccaggagggccccctccccgagatcgaggacgaggtgttcaagaagcgcaacctgacgatcatggacctgcacccggggagcggcaagacccggcgctacctccccgcgatcgtccgggaggccatcaagcgcaagctgcggaccctgatcctcgcccccacccgcgtggtggccagcgagatggcggaggccctgaagggcatgcccatccgctaccagacgaccgccgtcaagtccgagcacaccgggcgggagatcgtggacctgatgtgccacgccaccttcacgatgcgcctcctgagcccggtgcgggtccccaactacaacatgatcatcatggacgaggcccacttcaccgaccccgcgtccatcgccgcccgcggctacatcagcacccgggtggggatgggcgaggccgccgcgatcttcatgaccgccacgcccccggggtccgtggaggccttcccccagagcaacgccgtcatccaggacgaggagcgcgacatccccgagcggtcctggaacagcggctacgactggatcaccgacttccccggcaagaccgtgtggttcgtgccgtccatcaagagcgggaacgacatcgccaactgcctgcgcaagaacggcaagcgggtcatccagctctcccgcaagaccttcgacacggagtaccagaagaccaagaacaacgactgggactacgtggtgaccaccgacatcagcgagatgggggcgaacttccgggccgaccgcgtcatcgacccccggcgctgcctgaagcccgtgatcctgaaggacggccccgagcgggtgatcctcgccgggccgatgcccgtcacggtggcctccgcggcccagcgccggggccgcatcggccggaaccagaacaaggagggggaccagtacgtctacatgggccagcccctgaacaacgacgaggaccacgcccactggaccgaggccaagatgctgctcgacaacatcaacacccccgaggggatcatcccggccctgttcgagcccgagcgcgagaagtccgcggccatcgacggcgagtaccgcctgcgcggggaggcccgcaagaccttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggacgaaggagggcgagcgcaagaagctgcggccccgctggctggacgcccggacctacagcgacccgctcgcgctgcgcgagttcaaggagttcgccgccgggcggcgctccgtcagcggcgacctgatcctcgagatcggcaagctgccccagcacctgaccctccgggcccagaacgccctggacaacctggtgatgctccacaacagcgagcagggcgggaaggcgtaccgccacgccatggaggagctgcccgacaccatcgagaccctgatgctcctggccctgatcgccgtgctcaccgggggcgtcaccctgttcttcctgtccgggaagggcctcggcaagaccagcatcgggctgctgtgcgtgatggcgtccagcgccctcctgtggatggcctccgtggagccccactggatcgccgccagcatcatcctggagttcttcctcatggtcctgctgatcccggagcccgaccggcagcgcacgccccaggacaaccagctcgcgtacgtggtgatcggcctgctgttcatgatcctcacggtcgccgccaacgagatggggctgctggagaccaccaagaaggacctcggcatcgggcacgtggccgccgagaaccaccaccacgcgaccatgctggacgtggacctgcggccggcctccgcctggacgctctacgccgtcgccaccaccgtgatcacccccatgatgcgccacacgatcgagaacaccaccgcgaacatcagcctgaccgccatcgccaaccaggccgccatcctgatgggcctcgacaagggctggcccatctccaagatggacatcggggtgcccctgctggcgctcggctgctacagccaggtcaacccgctgacgctgaccgccgccgtgctcatgctggtggcccactacgcgatcatcgggcccggcctgcaggcccgggccacccgcgaggcccagaagcgcaccgccgcggggatcatgaagaaccccacggtcgacggcatcgtggccatcgacctcgaccccgtggtctacgacgccaagttcgagaagcagctgggccagatcatgctgctcatcctgtgcacctcccagatcctgctcatgcggaccacctgggccctgtgcgagagcatcacgctggccaccgggccgctcaccaccctgtgggagggctcccccgggaagttctggaacacgaccatcgcggtgagcatggccaacatcttccgcggctcctacctggccggcgccgggctcgccttcagcctgatgaagtccctgggcgggggccggcgcgggaccggcgcgcagggcgagaccctcggggagaagtggaagcggcagctgaaccagctgagcaagtccgagttcaacacgtacaagcgcagcggcatcatggaggtggaccggagcgaggccaaggaggggctcaagcgcggcgagaccaccaagcacgccgtctcccgggggaccgccaagctgcgctggttcgtggagcggaacctggtgaagcccgagggcaaggtcatcgacctgggctgcgggcgcggcgggtggagctactactgcgcgggcctcaagaaggtgacggaggtgaaggggtacaccaagggcggccccgggcacgaggagccgatccccatggccacctacggctggaacctggtcaagctgcactccgggaaggacgtgttcttcacgccgcccgagaagtgcgacaccctcctgtgcgacatcggcgagagctccccgaaccccacgatcgaggaggggcggaccctgcgcgtgctcaagatggtcgagccctggctgcggggcaaccagttctgcatcaagatcctgaacccctacatgccgagcgtggtggagaccctcgagcagatgcagcgcaagcacggcgggatgctggtccggaaccccctgtcccgcaacagcacccacgagatgtactgggtgtcctgcggcacggggaacatcgtgagcgccgtcaacatgacctcccggatgctcctgaaccgcttcaccatggcccaccgcaagcccacctacgagcgggacgtggacctgggcgccggcacgcgccacgtggcggtcgagcccgaggtggccaacctcgacatcatcgggcagcggatcgagaacatcaagaacgagcacaagagcacctggcactacgacgaggacaacccgtacaagacctgggcctaccacggctcctacgaggtgaagcccagcgggtccgccagctccatggtcaacggcgtggtccgcctgctgaccaagccctgggacgtgatccccatggtgacgcagatcgccatgaccgacaccaccccgttcgggcagcagcgggtcttcaaggagaaggtggacacgcgcacgccccgggcgaagcgcggcaccgcccagatcatggaggtgaccgccaagtggctctggggcttcctgagccggaacaagaagccccgcatctgcacgcgggaggagttcacccgcaaggtccggtccaacgccgccatcggggcggtgttcgtggacgagaaccagtggaacagcgccaaggaggccgtcgaggacgagcgcttctgggacctggtgcggcgcgagcgggagctccacaagcagggcaagtgcgcgacctgcgtgtacaacatgatggggaagcgcgagaagaagctgggcgagttcgggaaggcgaagggcagccgggccatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatcccgggcggcaacatgtacgccgacgacaccgcggggtgggacacgcgcatcaccgaggacgacctccagaacgaggccaagatcaccgacatcatggagcccgagcacgccctgctggccacctccatcttcaagctcacgtaccagaacaaggtggtgcgggtccagcgccccgccaagaacggcaccgtgatggacgtgatcagccggcgcgaccagcgggggtccggccaggtcggcacctacgggctgaacaccttcacgaacatggaggtgcagctgatccgccagatggagagcgagggcatcttcctcccctccgagctggagaccccgaacctggcggagcgggtgctcgactggctggagaagcacggggccgagcgcctgaagcggatggccatcagcggcgacgactgcgtcgtgaagcccgtggacgaccgcttcgccaccgccctcatcgcgctgaacgacatggggaaggtccggaaggacatcccccagtgggagccctccaagggctggaacgactggcagcaggtcccgttctgcagccaccacttccaccagctgatcatgaaggacggccgcgagatcgtggtcccctgccggaaccaggacgagctcgtggggcgcgcccgggtgtcccagggcgccgggtggagcctgcgcgagaccgcctgcctgggcaagtcctacgcccagatgtggcagctcatgtacttccaccggcgcgacctgcggctggcggccaacgccatctgcagcgccgaccccgtcgactgggtgcccacgtcccgcaccacctggagcatccacgcgcaccaccagtggatgaccaccgaggacatgctcagcgtgtggaaccgcgtctggatcgaggagaacccgtggatggaggacaagacgcacgtgtccagctgggaggaggtgccctacctggggaagcgggaggaccagtggtgcggctccctgatcggcctcaccgcccgcgccacctgggccaccaacatccaggtcgccatcaaccaggtgcggcgcctgatcgggaacgagaactacctggactacatgatcagcatgaagcggttcaagaacgagtccgaccccgagggcgcgctctggtga

SEQ ID NO: 8223 - RNA, 9879 nt, synthetic construct
  misc_feature 1..9879: note = derived and/or modified CDS sequence (opt1) from DENV-1__FJ410187__SS-prME
  source 1..9879: mol_type = other RNA
agcgtgaccatgctgctcatgctgctgcccaccgccctcgccttccacctgaccacccggggcggggagccccacatgatcgtgtccaagcaggagcggggcaagagcctcctgttcaagacctccgccgggatcaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtcgccctggcgccccacgtgggcctggggctcgagacccgcaccgagacctggatgagctccgagggcgcctggaagcagatccagaaggtggagacctgggccctgcggcaccccgggttcacggtcaccgccctgttcctcgcgcacgccatcggcaccagcatcacccagaaggggatcatcttcatcctgctgatgctcgtgacgccctccatggccatgcgctgcgtgggcatcggcaaccgggacttcgtcgaggggctgagcggcgccacctgggtggacgtggtcctggagcacgggtcctgcgtgaccaccatggccaaggacaagcccacgctcgacatcgagctgctgaagaccgaggtgaccaaccccgcggtcctccgcaagctgtgcatcgaggccaagatcagcaacaccacgaccgactcccggtgcccgacccagggcgaggccaccctggtggaggagcaggacagcaacttcgtgtgccgccggacgttcgtcgaccgcggctgggggaacggctgcggcctcttcggcaaggggtccctgctgacctgcgccaagttcaagtgcgtgaccaagctcgagggcaagatcgtgcagtacgagaacctgaagtacagcgtcatcgtgaccgtgcacacgggcgaccagcaccaggtcgggaacgagaccaccgagcacggcaccatcgccaccatcacgccccaggcgcccacctccgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggaccagcggggccagcacctcccaggagacgtggaaccgccaggacctcctggtgaccttcaagaccgcccacgccaagaagcaggaggtggtcgtgctgggcagccaggagggcgcgatgcacaccgccctcacgggggccaccgagatccagacctccggcaccacgaccatcttcgccgggcacctgaagtgccggctgaagatggacaagctcaccctgaagggcatgagctacgtgatgtgcaccgggtccttcaagctggagaaggaggtcgccgagacgcagcacggcaccgtgctggtgcaggtcaagtacgagggcaccgacgcgccctgcaagatccccttcagcgcccaggacgagaagggggtgacccagaacggccgcctcatcacggccaacccgatcgtgaccgacaaggagaagcccgtcaacatcgagaccgagccgcccttcggggagtcctacatcgtggtgggcgccggcgagaaggcgctgaagctgagctggttcaagaaggggtccagcatcggcaagatgttcgaggccaccgcccgcggggcccgccggatggccatcctcggcgacacggcgtgggacttcgggtccatcggcggcgtcttcaccagcgtggggaagctggtgcaccaggtcttcggcgccgcctacggggtgctgttctccggcgtgagctggaccatgaagatcgggatcggcatcctcctgacctggctgggcctcaactcccgcagcacgtccctgagcatgacctgcatcgccgtcgggatggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggcggacagcccgaagcggctgtccgccgccatcggcaaggcctgggaggagggggtgtgcggcatccgcagcgccacccggctcgagaacatcatgtggaagcagatctccaacgagctgaaccacatcctgctcgagaacgacatgaagttcaccgtggtcgtgggggacgcgaacggcatcctggcccaggggaagaagatgatccgcccccagcccatggagcaccggtacagctggaagtcctggggcaaggccaagatcatcggcgccgacatccagaacagcaccttcatcatcgacgggcccgacacgccggagtgccccgacgaccagcgcgcgtggaacatctgggaggtggaggactacggcttcgggatcttcaccaccaacatctggctgaagctccgggactcctacacccagatgtgcgaccaccgcctgatgagcgccgccatcaaggactccaaggccgtccacgccgacatgggctactggatcgagagcgagaagaacgagacgtggaagctggcgcgggcctccttcatcgaggtgaagacctgcatctggcccaagagccacaccctctggtccaacggcgtgctggagagcgagatgatcatccccaagatctacgggggcccgatctcccagcacaactaccgccccgggtacttcacccagacggccggcccctggcacctggggaagctcgagctggacttcgacctgtgcgagggcaccaccgtcgtggtggacgagcactgcggcaaccgggggccgagcctccgcaccacgaccgtcaccggcaagatcatccacgagtggtgctgccggtcctgcaccctgccgcccctgcgcttccgcggggaggacggctgctggtacgggatggagatccgccccgtgaaggagaaggaggagaacctcgtgcggagcatggtcagcgccggctccggcgaggtggacagcttctccctggggatcctgtgcgtgagcatcatgatcgaggaggtcatgcgctcccggtggagccgcaagatgctcatgacgggcaccctggccgtgttcctgctcctgatcatggggcagctgacctggaacgacctcatccgcctgtgcatcatggtgggcgcgaacgcctccgaccggatggggatgggcaccacgtacctggccctcatggccaccttcaagatgcgcccgatgttcgccgtcgggctgctgttccggcgcctcaccagccgggaggtgctgctgctcaccatcgggctgtccctggtggcgagcgtcgagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggcgcaccatggccatggtgctgagcatcgtctccctgttccccctctgcctgagcaccacgtcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtgagcatcctgctcagctccctgctgaagaacgacgtccccctcgccgggccgctgatcgccggcggcatgctgatcgcctgctacgtgatcagcgggtccagcgccgacctctccctggagaaggcggccgaggtgagctgggaggaggaggccgagcactccggcaccagccacaacatcctggtcgaggtgcaggacgacgggaccatgaagatcaaggacgaggagcgcgacgacaccctcaccatcctgctgaaggccacgctcctggccgtgtccggcgtctaccccatgagcatccccgcgaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacaccatgtggcacgtcacgcgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagaccacccccggcacgttcaagacccccgagggcgaggtgggggcgatcgccctggacttcaagcccggcaccagcgggtccccgatcgtgaaccgggagggcaagatcgtcggcctgtacgggaacggcgtggtgaccacgagcgggacctacgtcagcgccatcgcccaggccaagacctcccaggagggccccctccccgagatcgaggaggaggtgttcaagaagcgcaacctgaccatcatggacctgcacccggggagcggcaagacgcggcgctacctccccgcgatcgtgcgggaggccatcaagcgcaagctgcgcaccctgatcctcgcccccacccgggtcgtggcctccgagatggcggaggccctgaagggcatgcccatccgctaccagaccacggccgtcaagagcgagcacaccgggcgggagatcgtcgacctgatgtgccacgccaccttcaccatgcgcctcctgtccccggtgcgggtgcccaactacaacatgatcatcatggacgaggcccacttcacggaccccgcgagcatcgccgcccgcggctacatctccacccgggtcgggatgggcgaggccgccgcgatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgccaactgcctgcgcaagaacggcaagcgggtgatccagctcagccgcaagaccttcgacaccgagtaccagaagacgcggaacaacgactgggactacgtcgtgaccaccgacatctccgagatgggggcgaacttccgcgccgaccgggtgatcgacccccgccggtgcctgaagcccgtcatcctgaaggacggccccgagcgcgtgatcctcgccgggccgatgcccgtgaccgtcgccagcgcggcccagcggcgcggccgcatcggccggaaccagaacaaggagggggaccagtacgtgtacatgggccagcccctgaacaacgacgaggaccacgcccactggacggaggccaagatgctgctcgacaacatcaacacccccgaggggatcatcccggccctgttcgagcccgagcgcgagaagtccgcggccatcgacggcgagtaccggctgcgcggggaggcccggaagaccttcgtcgagctcatgcgccggggcgacctgcccgtgtggctgagctacaaggtggcctccgagggcttccagtacagcgaccgccggtggtgcttcgacggggagcgcaacaaccaggtcctcgaggagaacatggacgtggagatctggaccaaggagggcgagcggaagaagctgcgcccccggtggctggacgcccgcacgtacagcgacccgctcgcgctgcgggagttcaaggagttcgccgccgggcgccggtccgtgagcggcgacctgatcctcgagatcggcaagctgccccagcacctgaccctccgcgcccagaacgccctggacaacctggtcatgctccacaactccgagcagggcgggaaggcgtaccggcacgccatggaggagctgcccgacaccatcgagaccctgatgctcctggccctgatcgccgtgctcaccgggggcgtgacgctgttcttcctgagcgggaagggcctcggcaagacctccatcgggctgctgtgcgtcatggcgagctccgccctcctgtggatggccaacgtggagccccactggatcgccgccagcatcatcctggagttcttcctcatggtgctgctgatcccggagcccgaccgccagcggacgccccaggacaaccagctcgcgtacgtcgtgatcggcctgctgttcatgatcctcaccgtggccgccaacgagatggggctgctggagacgaccaagaaggacctcggcatcgggcacgtcgccgccgagaaccagcaccacgcgaccatgctggacgtggacctgcgcccggcctccgcctggaccctctacgccgtggccacgaccgtcatcacccccatgatgcgccacaccatcgagaacacgaccgcgaacatcagcctgaccgccatcgccaaccaggccgccatcctgatgggcctcgacaagggctggcccatctccaagatggacatcggggtgcccctgctggcgctcggctgctacagccaggtgaacccgctgaccctgacggccgccgtcctcatgctggtggcccactacgcgatcatcgggcccggcctgcaggccaaggccacccgggaggcccagaagcgcaccgccgcggggatcatgaagaaccccaccgtggacggcatcgtcgccatcgacctcgaccccgtggtgtacgacgccaagttcgagaagcagctgggccagatcatgctgctcatcctgtgcacgtcccagatcctgctcatgcggaccacctgggccctgtgcgagagcatcaccctggccacggggccgctcaccaccctgtgggagggctcccccgggaagttctggaacaccacgatcgcggtcagcatggccaacatcttccgcggctcctacctggccggcgccgggctcgccttcagcctgatgaagtccctgggcgggggccggcgcgggaccggcgcgcagggcgagaccctcggggagaagtggaagcggcagctgaaccagctgagcaagagcgagttcaacacctacaagcgctccggcatcatggaggtggaccggagcgaggccaaggaggggctcaagcgcggcgagacgaccaagcacgccgtgtcccgggggaccgccaagctgcgctggttcgtcgagcggaacctggtgaagcccgagggcaaggtgatcgacctgggctgcgggcgcggcgggtggagctactactgcgcgggcctcaagaaggtcaccgaggtgaaggggtacacgaagggcggccccgggcacgaggagccgatccccatggccacctacggctggaacctggtgaagctgtactccgggaaggacgtcttcttcacgccgcccgagaagtgcgacaccctcctgtgcgacatcggcgagagctccccgaaccccaccatcgaggaggggcggacgctgcgcgtgctcaagatggtggagccctggctgcggggcaaccagttctgcatcaagatcctgaacccctacatgccgagcgtcgtggagaccctcgagcagatgcagcgcaagcacggcgggatgctggtgcggaaccccctgtcccgcaacagcacccacgagatgtactgggtctcctgcggcaccgggaacatcgtgagcgccgtgaacatgacgtcccgcatgctcctgaaccggttcaccatgacccaccgcaagcccacctacgagcgggacgtcgacctgggcgccggcacgcgccacgtggccgtggagcccgaggtcgcgaacctcgacatcatcgggcagcggatcgagaacatcaagaacgagcacaagagcacctggcactacgacgaggacaacccgtacaagacctgggcctaccacggctcctacgaggtgaagcccagcgggtccgccagctccatggtgaacggcgtcgtgcgcctgctgaccaagccctgggacgtcatccccatggtgacgcagatcgccatgaccgacaccaccccgttcgggcagcagcgggtgttcaaggagaaggtcgacacgcgcacgccccgggccaagcgcggcaccgcgcagatcatggaggtgaccgccaagtggctctggggcttcctgagccggaacaagaagccccgcatctgcacgcgggaggagttcacccgcaaggtgcggagcaacgccgccatcggggccgtcttcgtggacgagaaccagtggaactccgcgaaggaggccgtggaggacgagcgcttctgggacctggtccaccgggagcgcgagctccacaagcagggcaagtgcgcgacctgcgtgtacaacatgatggggaagcgggagaagaagctgggcgagttcgggaaggccaagggcagccgcgcgatctggtacatgtggctgggcgcccggttcctcgagttcgaggccctggggttcatgaacgaggaccactggttctcccgcgagaacagcttctccggcgtggagggggagggcctgcacaagctcgggtacatcctgcgcgacatcagcaagatcccgggcggcaacatgtacgccgacgacaccgccgggtgggacacgcggatcaccgaggacgacctgcagaacgaggcgaagatcaccgacatcatggagcccgagcacgccctcctggccacctccatcttcaagctgacgtaccagaacaaggtcgtgcgcgtgcagcggcccgccaagaacggcaccgtcatggacgtgatcagccgccgggaccagcgcgggtccggccaggtgggcacctacgggctcaacaccttcacgaacatggaggtccagctgatccggcagatggagagcgagggcatcttcctgccctccgagctcgagaccccgaacctggccgagcgcgtgctggactggctcgagaagcacgggaccgagcggctgaagcgcatggcgatcagcggcgacgactgcgtggtcaagcccgtggacgaccggttcgccaccgccctgatcgccctcaacgacatggggaaggtgcgcaaggacatcccccagtgggagccctccaagggctggaacgactggcagcaggtcccgttctgcagccaccacttccaccagctgatcatgaaggacggccgggagatcgtggtgccctgccgcaaccaggacgagctggtcgggcgggcccgcgtgtcccagggcgcggggtggagcctccgggagacggcctgcctgggcaagtcctacgcccagatgtggcagctgatgtacttccaccgccgggacctccgcctggccgccaacgcgatctgcagcgccgtgcccgtcgactgggtgcccaccagccgcaccacctggtccatccacgcccaccaccagtggatgaccacggaggacatgctgagcgtgtggaaccgggtctggatcgaggagaacccgtggatggaggacaagacccacgtgtccagctgggaggaggtgccctacctcgggaagcgcgaggaccagtggtgcggctccctgatcggcctgaccgcccgggcgacctgggccacgaacatccaggtcgccatcaaccaggtgcgccggctcatcgggaacgagaactacctggactacatgaccagcatgaagcgcttcaagaacgagtccgaccccgagggcgccctgtggtga

SEQ ID NO: 8224 - RNA, 9879 nt, synthetic construct
  misc_feature 1..9879: note = derived and/or modified CDS sequence (opt1) from DENV-1__FJ478457__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagcacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcatgttcacctccgtggggaagctggtgcaccaggtcttcggcaccgcctacggggtgctgttcagcggcgtgtcctggaccatgaagatcgggatcggcatcctcctgacgtggctgggcctcaacagccgctccaccagcctgtccatgacctgcatcgccgtcgggatggtgaccctgtacctcggcgtgatggtccaggccgacagcgggtgcgtgatcaactggaagggccgcgagctgaagtgcgggtccggcatcttcgtgacgaacgaggtccacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcaccgtggtcgtgggggacgcctccggcatcctggcgcaggggaagaagatgatccgcccccagcccatggagcacaagtacagctggaagtcctggggcaaggccaagatcatcggcgccgacatccagaacacgaccttcatcatcgacgggcccgacaccccggagtgcagcgacgaccagcgggcctggaacatctgggaggtggaggactacggcttcgggatcttcaccacgaacatctggctgaagctccgcgactcctacacccagatgtgcgaccaccggctgatgagcgcggccatcaaggactccaaggccgtccacgccgacatgggctactggatcgagagcgagaagaacgagacctggaagctggcccgcgcgtccttcatcgaggtgaagacctgcatctggcccaagagccacacgctctggtccaacggcgtgctggagagcgagatgatcatccccaagatctacgggggccccatctcccagcacaactaccggccggggtacttcacccagaccgccggcccctggcacctggggaagctcgagctggacttcgacctgtgcgagggcaccacggtcatcgtggacgagcactgcggcaaccgcgggcccagcctccggaccaccaccgtgacgggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgagcgccggctccggcgaggtcgacagcttctccctggggatcctgtgcgtgagcatcatgatcgaggaggtgatgcggtcccgctggagccggaagatgctcatgaccggcaccctggccgtcttcctgctcctgatcatggggcagctgacgtggaacgacctcatccgcctgtgcatcatggtgggcgccaacgcgtccgaccgcatggggatgggcaccacctacctggccctcatggccaccttcaagatgcggcccatgttcgccgtgggcctgctgttccgccggctcacgagccgcgaggtcctgctgctcaccatcgggctgtccctggtggccagcgtggagctcccgaactccctggaggagctgggcgacgggctcgcgatgggcatcatgatgctgaagctgctcaccgagttccagccccaccagctgtggaccacgctgctcagcctgaccttcatcaagaccaccctgtccctcgactacgcctggaagacgatggccatggccctgagcatcgtctccctgttccccctctgcctgagcaccacctcccagaagaccacgtggctgcccgtgctcctgggcagcttcgggtgcaagccgctgaccatgttcctcatcaccgagaacaagatctggggccggaagtcctggcccctgaacgaggggatcatggcgatcggcatcgtcagcatcctgctcagctccctgctgaagaacgacgtgcccctcgccgggcccctgatcgccggcggcatgctgatcgcctgctacgtgatcagcgggtccagcgccgacctctccctggagaaggcggccgaggtcagctgggaggaggaggccgagcactccggcaccagccacaacatgctggtggaggtgcaggacgacgggaccatgaagatcaaggacgaggagcgcgacgacacgctcaccatcctgctgaaggccaccctcctggccgtctccggcgtgtacccgatgagcatccccgcgaccctgttcgtgtggtacttctggcagaagaagaagcagcggtccggggtcctctgggacacgcccagcccgcccgaggtggagcgcgccgtgctggacgacggcatctaccggatcctgcagcgcggcctgctcgggcggtcccaggtcggcgtgggggtgttccaggacggcgtcttccacaccatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgccgtcgagcccgggaagaaccccaagaacgtgcagacgacccccggcaccttcaagacccccgagggcgaggtgggggcgatcgccctggacttcaagcccggcacgagcgggtcccccatcgtcaaccgggagggcaagatcgtgggcctgtacgggaacggcgtggtcaccaccagcgggacctacgtgagcgccatcgcccaggccaaggcgtcccaggagggcccgctccccgagatcgaggacgaggtgttccgcaagcggaacctgacgatcatggacctgcaccccgggagcggcaagacccgccggtacctcccggccatcgtccgcgaggccatcaagcggaagctgcgcaccctgatcctcgcccccacccgcgtggtggcgtccgagatggccgaggccctgaagggcatgcccatccggtaccagacgaccgccgtcaagagcgagcacaccgggcgcgagatcgtggacctgatgtgccacgccaccttcacgatgcggctcctgtcccccgtgcgcgtcccgaactacaacatgatcatcatggacgaggcgcacttcaccgaccccgccagcatcgccgcccggggctacatctccacccgcgtggggatgggcgaggccgcggccatcttcatgaccgccacgccgcccgggagcgtggaggccttcccgcagtccaacgccgtcatccaggacgaggagcgggacatccccgagcgcagctggaactccggctacgactggatcaccgacttccccggcaagaccgtgtggttcgtgcccagcatcaagtccgggaacgacatcgcgaactgcctgcggaagaacggcaagcgcgtcatccagctcagccggaagaccttcgacacggagtaccagaagaccaagaacaacgactgggactacgtggtgaccaccgacatctccgagatgggggccaacttccgcgccgaccgggtcatcgacccgcgccggtgcctgaagcccgtgatcctgaaggacggccccgagcgcgtgatcctcgccgggcccatgccggtcacggtggcgagcgccgcccagcggcgcggccggatcggccgcaaccagaacaaggagggggaccagtacgtgtacatgggccagcccctgaacaacgacgaggaccacgcccactggaccgaggccaagatgctgctcgacaacatcaacacccccgaggggatcatccccgcgctgttcgagccggagcgcgagaagtccgccgccatcgacggcgagtaccggctgcgcggggaggcccggaagaccttcgtcgagctcatgcgccggggcgacctgcccgtgtggctgagctacaaggtcgcctccgagggcttccagtacagcgaccgccggtggtgcttcgacggggagcgcaacaaccaggtgctcgaggagaacatggacgtggagatctggacgaaggagggcgagcggaagaagctgcgcccccggtggctggacgcgcgcacctacagcgaccccctcgccctgcgggagttcaaggagttcgccgccgggcgccggtccgtcagcggcgacctgatcctcgagatcggcaagctgccgcagcacctgaccctccgcgcccagaacgcgctggacaacctggtgatgctccacaactccgagcagggcgggaaggcctaccggcacgccatggaggagctgcccgacaccatcgagaccctgatgctcctggccctgatcgcggtgctcaccggcggggtcaccctgttcttcctgagcgggaaggggctcggcaagacctccatcgggctgctgtgcgtgatggccagctccgccctcctgtggatggccagcgtggagccccactggatcgccgcgtccatcatcctggagttcttcctcatggtcctgctgatccccgagccggaccgccagcggacgccccaggacaaccagctcgcctacgtggtgatcggcctgctgttcatgatcctcacggtcgccgccaacgagatggggctgctggagaccaccaagaaggacctcggcatcgggcacgtggccgcggagaaccaccaccacgccaccatgctggacgtggacctgcgccccgccagcgcctggacgctctacgccgtcgcgaccaccgtgatcaccccgatgatgcggcacacgatcgagaacaccaccgccaacatctccctgaccgccatcgccaaccaggccgcgatcctgatgggcctcgacaagggctggcccatcagcaagatggacatcggggtgcccctgctggccctcggctgctactcccaggtcaaccccctgacgctgaccgccgccgtgctcatgctggtggcgcactacgccatcatcgggccgggcctgcaggccaaggccacccgcgaggcccagaagcgcaccgcggccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcggaccacctgggccctgtgcgagtccatcacgctggcgaccgggcccctcaccaccctgtgggagggcagcccggggaagttctggaacacgaccatcgccgtgtccatggccaacatcttccgcggcagctacctggccggcgccgggctcgcgttctccctgatgaagtccctgggcgggggccggcgcgggaccggcgcccagggcgagaccctcggggagaagtggaagcggcagctgaaccagctgagcaagtccgagttcaacacgtacaagcgcagcggcatcatggaggtggaccggtccgaggccaaggaggggctcaagcgcggcgagaccaccaagcacgccgtcagccgggggaccgcgaagctgcgctggttcgtggagcggaacctggtgaagcccgagggcaaggtcatcgacctgggctgcgggcgcggcgggtggtcctactactgcgccggcctcaagaaggtgacggaggtgaaggggtacaccaagggcggccccgggcacgaggagcccatcccgatggccacctacggctggaacctggtcaagctgcacagcgggaaggacgtgttcttcacgccgcccgagaagtgcgacaccctcctgtgcgacatcggcgagtccagccccaacccgacgatcgaggaggggcggaccctgcgcgtgctcaagatggtcgagccctggctgcggggcaaccagttctgcatcaagatcctgaacccctacatgccctccgtggtggagaccctcgagcagatgcagcgcaagcacggcgggatgctggtccggaacccgctgagccgcaactccacccacgagatgtactgggtgagctgcggcacggggaacatcgtgtccgccgtcaacatgaccagccggatgctcctgaaccgcttcaccatggcccaccgcaagcccacctacgagcgggacgtggacctgggcgcgggcacgcgccacgtggccgtcgagcccgaggtggccaacctcgacatcatcgggcagcggatcgagaacatcaagaacgagcacaagtccacctggcactacgacgaggacaacccctacaagacctgggcctaccacggcagctacgaggtgaagccgtccgggagcgcctccagcatggtcaacggcgtggtgcgcctgctgaccaagccctgggacgtcatccccatggtgacgcagatcgcgatgaccgacaccacccccttcgggcagcagcgggtcttcaaggagaaggtggacacgcgcaccccgcgggccaagcgcggcaccgcccaggtgatggaggtcaccgccaagtggctctggggcttcctgagccggaacaagaagccccgcatctgcacgcgggaggagttcacccgcaaggtgcggtccaacgccgcgatcggggccgtgttcgtcgacgagaaccagtggaacagcgccaaggaggccgtggaggacgagaagttctgggacctggtgcaccgcgagcgggagctccacaagcagggcaagtgcgcgacctgcgtctacaacatgatggggaagcgcgagaagaagctgggcgagttcgggaaggccaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatccccggcggcaacatgtacgcggacgacaccgccgggtgggacacgcggatcaccgaggacgacctccagaacgaggccaagatcaccgacatcatggagccggagcacgccctgctggccaccagcatcttcaagctcacgtaccagaacaaggtggtccgcgtgcagcgccccgcgaagaacggcaccgtgatggacgtcatctcccggcgcgaccagcgggggagcggccaggtgggcacctacgggctgaacaccttcacgaacatggaggtgcagctgatccgccagatggagtccgagggcatcttcctccccagcgagctggagacccccaacctggccgagcgggtcctcgactggctggagaagcacgggaccgagcgcctgaagcggatggccatctccggcgacgactgcgtggtgaagccgatcgacgaccgcttcgccaccgccctcatcgcgctgaacgacatggggaaggtccggaaggacatcccccagtgggagcccagcaagggctggaacgagtggcagcaggtccccttctgctcccaccacttccaccagctgatcatgaaggacggccgcgagatcgtggtcccgtgccggaaccaggacgagctcgtggggcgcgcccgggtgagccagggcgccgggtggtccctgcgcgagacggcctgcctgggcaagagctacgcccagatgtggcagctcatgtacttccaccggcgcgacctgcggctggcggccaacgccatctgcagcgccgtccccgtggactgggtgcccacctcccgcaccacctggagcatccacgcgcaccaccagtggatgaccacggaggacatgctctccgtctggaaccgggtgtggatcgaggagaacccctggatggaggacaagacccacgtgagctcctgggaggaggtcccgtacctggggaagcgcgaggaccagtggtgcggcagcctgatcggcctcaccgcccgcgccacctgggccacgaacatccaggtggccatcaaccaggtgcggcgcctgatcgggaacgagaactacctggactacatgacctccatgaagcggttcaagaacgagagcgaccccgagggcgcgctctggtga

SEQ ID NO: 8225 - RNA, 9879 nt, synthetic construct
  misc_feature 1..9879: note = derived and/or modified CDS sequence (opt1) from DENV-1__FJ410188__SS-prME
  source 1..9879: mol_type = other RNA
agcgtgaccatgctgctcatgctgctgcccaccgtgctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacacgatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacgcgcaccgagacctggatgagctccgagggcgcctggaagcagatccagaaggtggagacctgggccctgcggcaccccgggttcacggtgatcgccctgttcctcgcccacgcgatcggcaccagcatcacccagaaggggatcatcttcatcctgctgatgctcgtgaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgcccgacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagcacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttctccacccaggacgagaagggggtcacccagaacggccgcctcatcacggccaacccgatcgtgaccgacaaggagaagcccgtgaacatcgagaccgagccgcccttcggggagagctacatcgtcgtgggcgccggcgagaaggccctgaagctgtcctggttcaagaaggggagctccatcggcaagatgttcgaggcgaccgcccgcggggcccgccggatggccatcctcggcgacacggcctgggacttcgggagcatcggcggcatgttcacctccgtggggaagctggtccaccaggtgttcggcaccgcgtacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgcgagctgaagtgcgggtccggcatcttcgtcacgaacgaggtgcacacctggaccgagcagtacaagttccaggccgacagcccgaagcggctgagcgccgcgatcggcaaggcctgggaggagggggtgtgcggcatccgctccgccacccggctcgagaacatcatgtggaagcagatcagcaacgagctgaaccacatcctgctcgagaacgacatgaagttcaccgtcgtggtgggggacgcctccggcatcctggcccaggggaagaagatgatccgcccccagcccatggagcacaagtacagctggaagtcctggggcaaggcgaagatcatcggcgccgacatccagaacacgaccttcatcatcgacgggcccgacaccccggagtgcagcgacgaccagcgggcctggaacatctgggaggtcgaggactacggcttcgggatcttcaccacgaacatctggctgaagctccgcgactcctacacccagatgtgcgaccaccggctgatgagcgccgcgatcaaggactccaaggccgtgcacgccgacatgggctactggatcgagagcgagaagaacgagacctggaagctggcccgcgcctccttcatcgaggtgaagacctgcatctggcccaagagccacacgctctggtccaacggcgtcctggagagcgagatgatcatccccaagatctacgggggccccatctcccagcacaactaccggccggggtacttcacccagaccgcgggcccctggcacctggggaagctcgagctggacttcgacctgtgcgagggcaccacggtgatcgtggacgagcactgcggcaaccgcgggcccagcctccggaccaccaccgtcacgggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtcagcgccggctccggcgaggtggacagcttctccctggggatcctgtgcgtgagcatcatgatcgaggaggtcatgcggtcccgctggagccggaagatgctcatgaccggcaccctggccgtgttcctgctcctgatcatggggcagctgacgtggaacgacctcatccgcctgtgcatcatggtgggcgccaacgcctccgaccgcatggggatgggcaccacctacctggcgctcatggccaccttcaagatgcggcccatgttcgccgtcggcctgctgttccgccggctcacgagccgcgaggtgctgctgctcaccatcgggctgtccctggtggccagcgtcgagctcccgaactccctggaggagctgggcgacgggctcgccatgggcatcatgatgctgaagctgctcaccgagttccagccccaccagctgtggaccacgctgctcagcctgaccttcatcaagaccaccctgtccctcgactacgcgtggaagacgatggccatggccctgagcatcgtgtccctgttccccctctgcctgagcaccacctcccagaagaccacgtggctgcccgtcctcctgggcagcttcgggtgcaagccgctgaccatgttcctcatcaccgagaacaagatctggggccggaagtcctggcccctgaacgaggggatcatggccatcggcatcgtgagcatcctgctcagctccctgctgaagaacgacgtgcccctcgcggggcccctgatcgccggcggcatgctgatcgcctgctacgtcatcagcgggtccagcgccgacctctccctggagaaggccgcggaggtgagctgggaggaggaggccgagcactccggcaccagccacaacatgctggtggaggtccaggacgacgggaccatgaagatcaaggacgaggagcgcgacgacacgctcaccatcctgctgaaggccaccctcctggccgtgtccggcgtgtacccgatgagcatccccgccaccctgttcgtctggtacttctggcagaagaagaagcagcggtccggggtgctctgggacacgcccagcccgcccgaggtggagcgcgcggtcctggacgacggcatctaccggatcctgcagcgcggcctgctcgggcggtcccaggtgggcgtgggggtcttccaggacggcgtgttccacaccatgtggcacgtgacccgcggggccgtcctgatgtaccagggcaagcggctggagcccagctgggcctccgtgaagaaggacctcatcagctacggcgggggctggcgcttccaggggtcctggaacaccggcgaggaggtgcaggtcatcgccgtggagcccgggaagaaccccaagaacgtgcagacgacccccggcaccttcaagacccccgagggcgaggtcggggccatcgcgctggacttcaagcccggcacgagcgggtcccccatcgtgaaccgggagggcaagatcgtgggcctgtacgggaacggcgtcgtgaccaccagcgggacctacgtgagcgccatcgcccaggccaaggcctcccaggagggcccgctccccgagatcgaggacgaggtcttccgcaagcggaacctgacgatcatggacctgcaccccgggagcggcaagacccgccggtacctcccggcgatcgtgcgcgaggccatcaagcggaagctgcgcaccctgatcctcgcccccacccgcgtggtcgcctccgagatggcggaggccctgaagggcatgcccatccggtaccagacgaccgccgtcaagagcgagcacaccgggcgcgagatcgtggacctgatgtgccacgccaccttcacgatgcggctcctgtcccccgtccgcgtgccgaactacaacatgatcatcatggacgaggcccacttcaccgaccccgcgagcatcgccgcccggggctacatctccacccgcgtggggatgggcgaggccgccgcgatcttcatgaccgccacgccgcccgggagcgtcgaggccttcccgcagtccaacgccgtgatccaggacgaggagcgggacatccccgagcgcagctggaactccggctacgactggatcaccgacttccccggcaagaccgtgtggttcgtccccagcatcaagtccgggaacgacatcgccaactgcctgcggaagaacggcaagcgcgtgatccagctcagccggaagaccttcgacacggagtaccagaagaccaagaacaacgactgggactacgtggtcaccaccgacatctccgagatgggggcgaacttccgcgccgaccgggtgatcgacccgcgccggtgcctgaagcccgtgatcctgaaggacggccccgagcgcgtcatcctcgccgggcccatgccggtgacggtggccagcgcggcccagcggcgcggccggatcggccgcaaccagaacaaggagggggaccagtacgtctacatgggccagcccctgaacaacgacgaggaccacgcccactggaccgaggccaagatgctgctcgacaacatcaacacccccgaggggatcatccccgccctgttcgagccggagcgcgagaagtccgcggccatcgacggcgagtaccggctgcgcggggaggcccggaagaccttcgtggagctcatgcgccggggcgacctgcccgtctggctgagctacaaggtggcctccgagggcttccagtacagcgaccgccggtggtgcttcgacggggagcgcaacaaccaggtgctcgaggagaacatggacgtcgagatctggacgaaggagggcgagcggaagaagctgcgcccccggtggctggacgcccgcacctacagcgaccccctcgcgctgcgggagttcaaggagttcgccgccgggcgccggtccgtgagcggcgacctgatcctcgagatcggcaagctgccgcagcacctgaccctccgcgcccagaacgccctggacaacctggtgatgctccacaactccgagcagggcgggaaggcgtaccggcacgccatggaggagctgcccgacaccatcgagaccctgatgctcctggccctgatcgccgtcctcaccggcggggtgaccctgttcttcctgagcgggaaggggctcggcaagacctccatcgggctgctgtgcgtgatggcgagctccgccctcctgtggatggccagcgtcgagccccactggatcgccgcctccatcatcctggagttcttcctcatggtgctgctgatccccgagccggaccgccagcggacgccccaggacaaccagctcgcgtacgtggtcatcggcctgctgttcatgatcctcacggtggccgccaacgagatggggctgctggagaccaccaagaaggacctcggcatcgggcacgtggccgccgagaaccaccaccacgcgaccatgctggacgtcgacctgcgccccgccagcgcctggacgctctacgccgtggccaccaccgtgatcaccccgatgatgcggcacacgatcgagaacaccaccgcgaacatctccctgaccgccatcgccaaccaggccgccatcctgatgggcctcgacaagggctggcccatcagcaagatggacatcggggtccccctgctggcgctcggctgctactcccaggtgaaccccctgacgctgaccgccgccgtgctcatgctggtcgcccactacgcgatcatcgggccgggcctgcaggccaaggccacccgcgaggcccagaagcgcaccgccgcggggatcatgaagaaccccacggtggacggcatcgtggccatcgacctcgaccccgtcgtgtacgacgccaagttcgagaagcagctgggccagatcatgctgctcatcctgtgcaccagccagatcctgctcatgcggaccacctgggccctgtgcgagtccatcacgctggccaccgggcccctcaccaccctgtgggagggcagcccggggaagttctggaacacgaccatcgcggtgtccatggccaacatcttccgcggcagctacctggccggcgccgggctcgccttctccctgatgaagtccctgggcgggggccggcgcgggaccggcgcgcagggcgagaccctcggggagaagtggaagcggcagctgaaccagctgagcaagtccgagttcaacacgtacaagcgcagcggcatcatggaggtcgaccggtccgaggccaaggaggggctcaagcgcggcgagaccaccaagcacgccgtgagccgggggaccgccaagctgcgctggttcgtggagcggaacctggtcaagcccgagggcaaggtgatcgacctgggctgcgggcgcggcgggtggtcctactactgcgcgggcctcaagaaggtgacggaggtcaaggggtacaccaagggcggccccgggcacgaggagcccatcccgatggccacctacggctggaacctggtgaagctgcacagcgggaaggacgtgttcttcacgccgcccgagaagtgcgacaccctcctgtgcgacatcggcgagtccagccccaacccgacgatcgaggaggggcggaccctgcgcgtcctcaagatggtggagccctggctgcggggcaaccagttctgcatcaagatcctgaacccctacatgccctccgtggtcgagaccctcgagcagatgcagcgcaagcacggcgggatgctggtgcggaacccgctgagccgcaactccacccacgagatgtactgggtgagctgcggcacggggaacatcgtctccgccgtgaacatgaccagccggatgctcctgaaccgcttcaccatggcccaccgcaagcccacctacgagcgggacgtggacctgggcgccggcacgcgccacgtcgcggtggagcccgaggtggccaacctcgacatcatcgggcagcggatcgagaacatcaagaacgagcacaagtccacctggcactacgacgaggacaacccctacaagacctgggcctaccacggcagctacgaggtcaagccgtccgggagcgcctccagcatggtgaacggcgtggtccgcctgctgaccaagccctgggacgtgatccccatggtcacgcagatcgccatgaccgacaccacccccttcgggcagcagcgggtgttcaaggagaaggtggacacgcgcaccccgcgggcgaagcgcggcaccgcccaggtcatggaggtgaccgccaagtggctctggggcttcctgagccggaacaagaagccccgcatctgcacgcgggaggagttcacccgcaaggtgcggtccaacgccgccatcggggcggtcttcgtggacgagaaccagtggaacagcgccaaggaggccgtggaggacgagaagttctgggacctggtccaccgcgagcgggagctccacaagcagggcaagtgcgcgacctgcgtgtacaacatgatggggaagcgcgagaagaagctgggcgagttcgggaaggcgaagggctcccgggccatctggtacatgtggctgggcgcccgcttcctcgagttcgaggccctggggttcatgaacgaggaccactggttcagccgggagaactccctgagcggcgtggagggggagggcctccacaagctggggtacatcctgcgcgacatctccaagatccccggcggcaacatgtacgccgacgacaccgcggggtgggacacgcggatcaccgaggacgacctccagaacgaggccaagatcaccgacatcatggagccggagcacgccctgctggccaccagcatcttcaagctcacgtaccagaacaaggtcgtgcgcgtgcagcgccccgccaagaacggcaccgtcatggacgtgatctcccggcgcgaccagcgggggagcggccaggtgggcacctacgggctgaacaccttcacgaacatggaggtccagctgatccgccagatggagtccgagggcatcttcctccccagcgagctggagacccccaacctggcggagcgggtgctcgactggctggagaagcacgggaccgagcgcctgaagcggatggccatctccggcgacgactgcgtggtcaagccgatcgacgaccgcttcgccaccgccctcatcgccctgaacgacatggggaaggtgcggaaggacatcccccagtgggagcccagcaagggctggaacgagtggcagcaggtccccttctgctcccaccacttccaccagctgatcatgaaggacggccgcgagatcgtcgtgccgtgccggaaccaggacgagctcgtggggcgcgcgcgggtcagccagggcgccgggtggtccctgcgcgagacggcctgcctgggcaagagctacgcccagatgtggcagctcatgtacttccaccggcgcgacctgcggctggccgcgaacgccatctgcagcgccgtgcccgtggactgggtccccacctcccgcaccacctggagcatccacgcccaccaccagtggatgaccacggaggacatgctctccgtgtggaaccgggtgtggatcgaggagaacccctggatggaggacaagacccacgtcagctcctgggaggaggtgccgtacctggggaagcgcgaggaccagtggtgcggcagcctgatcggcctcaccgcgcgcgccacctgggccacgaacatccaggtggccatcaaccaggtccggcgcctgatcgggaacgagaactacctggactacatgacctccatgaagcggttcaagaacgagagcgaccccgagggcgccctctggtga

SEQ ID NO: 8226 - RNA, 9879 nt, synthetic construct
  misc_feature 1..9879: note = derived and/or modified CDS sequence (opt1) from DENV-1__FJ478458__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccgggatcaacatgtgcaccctgatcgccatggacctgggcgagctctgcgaggacaccatgacctacaagtgcccccggatcaccgaggccgagcccgacgacgtggactgctggtgcaacgccaccgacacgtgggtgacctacgggacctgcagccagaccggcgagcaccggcgggacaagcggtccgtcgccctggcgccccacgtgggcctggggctcgagacgcgcaccgagacctggatgagctccgagggcgcctggaagcagatccagaaggtggagacctgggccctgcggcaccccgggttcacggtgaccgccctgttcctcgcgcacgccatcggcaccagcatcacccagaaggggatcatcttcatcctgctgatgctcgtgacgccctccatggccatgcgctgcgtgggcatcggcaaccgggacttcgtggaggggctgagcggcgccacctgggtggacgtggtcctggagcacgggtcctgcgtgaccaccatggccaaggacaagcccacgctcgacatcgagctgctgaagaccgaggtgaccaaccccgcgatcctccgcaagctgtgcatcgaggccaagatcagcaacaccacgaccgactcccggtgccccacccagggcgaggccaccctggtcgaggagcaggacagcaacttcgtgtgccgccggacgttcgtggaccgcggctgggggaacggctgcggcctcttcggcaaggggtccctgctgacctgcgccaagttcaagtgcgtcaccaagctcgagggcaagatcgtgcagtacgagaacctgaagtacagcgtgatcgtcaccgtgcacacgggcgaccagcaccaggtggggaacgagaccaccgagcacggcaccatcgccaccatcacgccccaggcgcccacctccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggccagcacctcccaggagacgtggaaccgccaggacctcctggtcaccttcaagaccgcccacgccaagaagcaggaggtggtggtcctgggcagccaggagggcgcgatgcacaccgccctcacgggggccaccgagatccagacctccggcaccacgaccatcttcgccgggcacctgaagtgccggctgaagatggacaagctcaccctgaagggcatgagctacgtgatgtgcaccgggtccttcaagctggagaaggaggtggccgagacgcagcacggcaccgtcctggtccaggtgaagtacgagggcaccgacgcgccctgcaagatccccttcagcgcccaggacgagaagggggtcacccagaacggccgcctcatcacggccaacccgatcgtgaccgacaaggagaagcccgtgaacatcgagaccgagccgcccttcggggagtcctacatcgtcgtgggcgccggcgagaaggcgctgaagctgagctggttcaagaaggggtccagcatcggcaagatgttcgaggccaccgcccgcggggcccgccggatggccatcctcggcgacacggcgtgggacttcgggtccatcggcggcgtgttcaccagcgtcgggaagctggtgcaccaggtgttcggcgccgcctacggggtcctgttctccggcgtgagctggaccatgaagatcgggatcggcatcctcctgacctggctgggcctcaactcccgcagcacgtccctgagcatgacctgcatcgccgtggggatggtcaccctgtacctcggcgtgatggtgcaggccgactccgggtgcgtcatcaactggaagggccgcgagctgaagtgcgggagcggcatcttcgtgaccaacgaggtgcacacgtggaccgagcagtacaagttccaggcggacagcccgaagcggctgtccgccgccatcggcaaggcctgggaggagggggtctgcggcatccgcagcgccacccggctcgagaacatcatgtggaagcagatctccaacgagctgaaccacatcctgctcgagaacgacatgaagttcaccgtggtggtcggggacgcgaacggcatcctggcccaggggaagaagatgatccgcccccagcccatggagcaccggtacagctggaagtcctggggcaaggccaagatcatcggcgccgacatccagaacaccacgttcatcatcgacgggcccgacaccccggagtgccccgacgaccagcgcgcgtggaacatctgggaggtggaggactacggcttcgggatcttcaccaccaacatctggctgaagctccgggacagctacacgcagatgtgcgaccaccgcctgatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacaccctctggagcaacggcgtgctggagtccgagatgatcatccccaagatctacgggggcccgatcagccagcacaactaccgccccgggtacttcacgcagaccgccggcccctggcacctggggaagctcgagctggacttcgacctgtgcgagggcaccaccgtggtcgtggacgagcactgcggcaaccgggggccgtccctccgcacgaccaccgtgaccggcaagatcatccacgagtggtgctgccggagctgcacgctgccgcccctgcgcttccgcggggaggacggctgctggtacgggatggagatccgccccgtcaaggagaaggaggagaacctcgtgcggtccatggtgagcgccggcagcggcgaggtcgactccttcagcctggggatcctgtgcgtgtccatcatgatcgaggaggtgatgcgcagccggtggtcccgcaagatgctcatgaccggcaccctggccgtcttcctgctcctgatcatggggcagctgacctggaacgacctcatccgcctgtgcatcatggtgggcgcgaacgccagcgaccggatggggatgggcacgacctacctggccctcatggccaccttcaagatgcgcccgatgttcgccgtgggcctgctgttccggcgcctcacctcccgggaggtcctgctgctcacgatcgggctgagcctggtggcgtccgtggagctccccaacagcctggaggagctgggcgacgggctcgccatgggcatcatgatgctgaagctgctcaccgagttccagccccaccagctgtggaccaccctgctctccctgacgttcatcaagaccaccctgagcctcgactacgcctggcgcaccatggccatggtcctgtccatcgcgagcctgttccccctctgcctgtccacgaccagccagaagaccacctggctgccggtgctcctgggctccttcgggtgcaagcccctgacgatgttcctcatcaccgagaacaagatctggggccgcaagagctggcccctgaacgaggggatcatggccatcggcatcgtctccatcctgctcagcagcctgctgaagaacgacgtgcccctcgccgggccgctgatcgccggcggcatgctgatcgcctgctacgtgatctccgggagctccgcggacctcagcctggagaaggccgccgaggtctcctgggaggaggaggccgagcacagcggcacctcccacaacatcctggtggaggtgcaggacgacgggaccatgaagatcaaggacgaggagcgcgacgacaccctcacgatcctgctgaaggccaccctcctggcggtcagcggcgtgtaccccatgtccatccccgccaccctgttcgtgtggtacttctggcagaagaagaagcagcggagcggggtcctctgggacaccccctccccgcccgaggtggagcgcgccgtgctggacgacggcatctaccggatcctgcagcgcggcctgctcgggcggagccaggtcggcgtgggggtgttccaggacggcgtcttccacacgatgtggcacgtgacccgcggggccgtgctgatgtaccagggcaagcggctggagccctcctgggccagcgtcaagaaggacctcatctcctacggcgggggctggcgcttccaggggagctggaacaccggcgaggaggtccaggtgatcgcggtcgagcccgggaagaacccgaagaacgtgcagaccacgcccggcaccttcaagacccccgagggcgaggtgggggccatcgccctggacttcaagcccggcacctccgggagcccgatcgtcaaccgggagggcaagatcgtgggcctgtacgggaacggcgtggtcacgacctccgggacctacgtgagcgccatcgcccaggcgaagaccagccaggagggccccctccccgagatcgaggaggaggtgttcaagaagcgcaacctgacgatcatggacctgcacccggggtccggcaagacccggcgctacctccccgccatcgtccgggaggccatcaagcgcaagctgcgcaccctgatcctcgcccccacccgggtggtggcgagcgagatggccgaggccctgaagggcatgcccatccgctaccagacgaccgccgtcaagtccgagcacaccgggcgggagatcgtggacctgatgtgccacgccaccttcacgatgcgcctcctgagcccggtgcgggtccccaactacaacatgatcatcatggacgaggcgcacttcaccgaccccgcctccatcgccgcccgcggctacatcagcacccgggtggggatgggcgaggccgcggccatcttcatgaccgccacgcccccggggtccgtggaggccttcccccagagcaacgccgtcatccaggacgaggagcgcgacatccccgagcggtcctggaacagcggctacgactggatcaccgacttccccggcaagaccgtgtggttcgtgccgtccatcaagagcgggaacgacatcgcgaactgcctgcgcaagaacggcaagcgggtcatccagctctcccgcaagaccttcgacacggagtaccagaagaccaagaacaacgactgggactacgtggtgaccaccgacatcagcgagatgggggccaacttccgggccgaccgcgtcatcgacccccggcgctgcctgaagcccgtgatcctgaaggacggccccgagcgggtgatcctcgccgggccgatgcccgtcacggtggcgtccgccgcccagcgccggggccgcatcggccgcaaccagaacaaggagggggaccagtacgtgtacatgggccagcccctgaacaacgacgaggaccacgcccactggaccgaggccaagatgctgctcgacaacatcaacacccccgaggggatcatcccggcgctgttcgagcccgagcgggagaagtccgccgccatcgacggcgagtaccgcctgcgcggggaggcccgcaagaccttcgtcgagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggacgaaggagggcgagcgcaagaagctgcggccccgctggctggacgcgcggacctacagcgacccgctcgccctgcgcgagttcaaggagttcgccgccgggcggcgcagcgtctccggcgacctgatcctcgagatcggcaagctgccccagcacctgaccctccgggcccagaacgcgctggacaacctggtgatgctccacaacagcgagcagggcgggaaggcctaccgccacgccatggaggagctgcccgacaccatcgagaccctgatgctcctggccctgatcgcggtgctcaccggcggggtcaccctgttcttcctgtccgggaaggggctcggcaagaccagcatcgggctgctgtgcgtgatggcctccagcgccctcctgtggatggccaacgtggagccccactggatcgccgcgtccatcatcctggagttcttcctcatggtcctgctgatcccggagcccgaccggcagcgcacgccccaggacaaccagctcgcctacgtggtgatcggcctgctgttcatgatcctcacggtcgccgccaacgagatggggctgctggagaccaccaagaaggacctcggcatcgggcacgtggccgcggagaaccagcaccacgccaccatgctggacgtggacctgcggccggccagcgcctggacgctctacgccgtcgcgaccaccgtgatcacccccatgatgcgccacacgatcgagaacaccaccgccaacatctccctgaccgccatcgccaaccaggccgcgatcctgatgggcctcgacaagggctggcccatcagcaagatggacatcggggtgcccctgctggccctcggctgctactcccaggtcaacccgctgacgctgaccgccgccgtgctcatgctggtggcgcactacgccatcatcgggcccggcctgcaggccaaggccacccgcgaggcccagaagcggaccgcggccgggatcatgaagaaccccacggtcgacggcatcgtggccatcgacctcgaccccgtggtctacgacgccaagttcgagaagcagctgggccagatcatgctgctcatcctgtgcaccagccagatcctgctcatgcgcaccacctgggccctgtgcgagtccatcacgctggcgaccgggccgctcaccaccctgtgggagggcagccccgggaagttctggaacacgaccatcgccgtgtccatggccaacatcttccggggcagctacctggccggcgccgggctcgcgttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggccaaggaggggctcaagcggggcgagaccaccaagcacgccgtcagccgcgggaccgcgaagctgcggtggttcgtggagcgcaacctggtgaagcccgagggcaaggtcatcgacctgggctgcgggcggggcgggtggtcctactactgcgccggcctcaagaaggtgacggaggtgaaggggtacaccaagggcggccccgggcacgaggagccgatccccatggccacctacggctggaacctggtcaagctgtacagcgggaaggacgtgttcttcacgccgcccgagaagtgcgacaccctcctgtgcgacatcggcgagtccagcccgaaccccacgatcgaggaggggcgcaccctgcgggtgctcaagatggtcgagccctggctgcgcggcaaccagttctgcatcaagatcctgaacccctacatgccgtccgtggtggagaccctcgagcagatgcagcggaagcacggcgggatgctggtccgcaaccccctgagccggaactccacccacgagatgtactgggtgagctgcggcacggggaacatcgtgtccgccgtcaacatgaccagccgcatgctcctgaaccgcttcaccatgacccaccggaagcccacgtacgagcgcgacgtggacctgggcgccggcacccggcacgtggcggtcgagcccgaggtggccaacctcgacatcatcgggcagcgcatcgagaacatcaagaacgagcacaagtccacctggcactacgacgaggacaacccgtacaagacctgggcctaccacggcagctacgaggtgaagccctccgggagcgcctccagcatggtcaacggcgtggtgcggctgctgacgaagccctgggacgtcatccccatggtgacccagatcgccatgaccgacaccacgccgttcgggcagcagcgcgtcttcaaggagaaggtggacacccggacgccccgggcgaagcggggcaccgcccagatcatggaggtgacggccaagtggctctggggcttcctgtcccgcaacaagaagccccggatctgcacccgcgaggagttcacccggaaggtccgcagcaacgccgccatcggggcggtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggcgaagggctcccgggccatctggtacatgtggctgggcgcccgcttcctcgagttcgaggccctggggttcatgaacgaggaccactggttcagccgggagaactccttcagcggcgtcgagggggagggcctgcacaagctcgggtacatcctgcgcgacatctccaagatcccgggcggcaacatgtacgccgacgacacggcggggtgggacacccgcatcaccgaggacgacctgcagaacgaggccaagatcaccgacatcatggagcccgagcacgccctcctggccacgagcatcttcaagctgacctaccagaacaaggtggtgcgggtccagcgccccgccaagaacggcaccgtgatggacgtgatctcccggcgcgaccagcgggggagcggccaggtcggcacctacgggctcaacacgttcaccaacatggaggtgcagctgatccgccagatggagtccgagggcatcttcctgcccagcgagctcgagaccccgaacctggcggagcgggtgctggactggctcgagaagcacgggaccgagcgcctgaagcggatggccatctccggcgacgactgcgtcgtgaagcccgtggacgaccgcttcgccacggccctgatcgccctcaacgacatggggaaggtccggaaggacatcccccagtgggagcccagcaagggctggaacgactggcagcaggtcccgttctgctcccaccacttccaccagctgatcatgaaggacggccgcgagatcgtggtcccctgccggaaccaggacgagctggtggggcgcgcgcgggtgagccagggcgccgggtggtccctccgcgagaccgcctgcctgggcaagagctacgcccagatgtggcagctgatgtacttccaccggcgcgacctccggctggccgcgaacgccatctgctccgccgtccccgtggactgggtgcccaccagccgcaccacctggagcatccacgcccaccaccagtggatgacgaccgaggacatgctgtccgtctggaaccgcgtgtggatcgaggagaacccgtggatggaggacaagacccacgtgagctcctgggaggaggtcccctacctcgggaagcgggaggaccagtggtgcggcagcctgatcggcctgaccgcgcgcgccacgtgggccaccaacatccaggtggccatcaaccaggtgcggcgcctcatcgggaacgagaactacctggactacatgacctccatgaagcggttcaagaacgagagcgaccccgagggcgccctgtggtga

SEQ ID NO: 8227 - RNA, 9879 nt, synthetic construct
  misc_feature 1..9879: note = derived and/or modified CDS sequence (opt1) from DENV-1__FJ410190__SS-prME
  source 1..9879: mol_type = other RNA
agcgtgaccatgctgctcatgctgctgcccaccgccctcgccttccacctgaccacccggggcggggagccccacatgatcgtcagcaagcaggagcggggcaagagcctgctgttcaagaccagcgtggggatcaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgggacaagcggtccgtggccctggcgccccacgtgggcctggggctcgagacgcggaccgagacctggatgagctccgagggcgcctggaagcagatccagaaggtcgagacctgggccctgcggcacccggggttcaccgtgatcgccctgttcctcgcccacgcgatcggcaccagcatcacccagaaggggatcatcttcatcctgctgatgctcgtgaccccctccatggccatgcggtgcgtcggcatcggcaaccgggacttcgtggaggggctgagcggcgccacgtgggtggacgtcgtgctggagcacgggtcctgcgtgaccaccatggccaaggacaagcccaccctcgacatcgagctgctgaagacggaggtcaccaaccccgccgtgctccgcaagctgtgcatcgaggcgaagatcagcaacaccaccacggactcccggtgcccgacccagggcgaggccaccctggtggaggagcaggacagcaacttcgtctgccgccggaccttcgtggaccgcggctgggggaacggctgcggcctcttcggcaaggggtccctgctgacgtgcgccaagttcaagtgcgtgaccaagctcgagggcaagatcgtccagtacgagaacctgaagtacagcgtgatcgtgaccgtccacaccggcgaccagcaccaggtggggaacgagacgaccgagcacggcaccatcgccaccatcacgccccaggcccccacgtccgagatccagctgaccgactacggggcgctcaccctggactgcagcccccggaccggcctggacttcaacgagatggtcctcctgacgatgaaggagaagtcctggctggtgcacaagcagtggttcctcgacctgccgctgccctggaccagcggggccagcacctcccaggagacctggaaccgccaggacctcctggtgacgttcaagaccgcccacgccaagaagcaggaggtcgtggtgctgggcagccaggagggcgccatgcacaccgcgctcaccggggccacggagatccagacctccggcaccaccacgatcttcgccgggcacctgaagtgccggctgaagatggacaagctcaccctgaagggcatgagctacgtcatgtgcaccgggtccttcaagctggagaaggaggtggccgagacccagcacggcacggtgctggtccaggtgaagtacgagggcaccgacgccccctgcaagatccccttcagcgcgcaggacgagaagggggtgacccagaacggccgcctcatcaccgccaacccgatcgtcacggacaaggagaagcccgtgaacatcgagaccgagccgcccttcggggagtcctacatcgtgatcggcgccggcgagaaggccctgaagctgagctggttcaagaaggggtccagcatcggcaagatgttcgaggcgaccgcccgcggggcccgccggatggccatcctcggcgacaccgcctgggacttcgggtccatcggcggcgtcttcacgagcgtggggaagctggtgcaccaggtcttcggcgcggcctacggggtgctgttctccggcgtgagctggaccatgaagatcgggatcggcatcctcctgacctggctgggcctcaactcccgcagcacctccctgagcatgacgtgcatcgccgtcgggatggtgaccctgtacctcggcgtgatggtccaggccgactccgggtgcgtgatcaactggaagggccgcgagctgaagtgcgggagcggcatcttcgtgaccaacgaggtccacacctggacggagcagtacaagttccaggccgacagcccgaagcggctgtccgcggccatcggcaaggcctgggaggagggggtgtgcggcatccgcagcgccacccggctcgagaacatcatgtggaagcagatctccaacgagctgaaccacatcctgctcgagaacgacatgaagttcaccgtggtcgtgggggacgccaacggcatcctggcgcaggggaagaagatgatccgcccccagcccatggagcaccggtacagctggaagtcctggggcaaggccaagatcatcggcgccgacatccagaacaccaccttcatcatcgacgggcccgacacgccggagtgccccgacgaccagcgcgcctggaacatctgggaggtggaggactacggcttcgggatcttcaccaccaacatctggctgaagctccgggacagctacacccagatgtgcgaccaccgcctgatgtccgcggccatcaaggacagcaaggccgtccacgccgacatgggctactggatcgagtccgagaagaacgagacgtggaagctggcccgggcgagcttcatcgaggtgaagacctgcatctggcccaagtcccacaccctctggagcaacggcgtgctggagtccgagatgatcatccccaagatctacgggggcccgatcagccagcacaactaccgccccgggtacttcacccagacggccggcccctggcacctggggaagctcgagctggacttcgacctgtgcgagggcaccaccgtcgtggtggacgagcactgcggcaaccgggggccgtccctccgcaccacgaccgtcaccggcaagatcatccacgagtggtgctgccggagctgcaccctgccgcccctgcgcttccgcggggaggacggctgctggtacgggatggagatccgccccgtgaaggagaaggaggagaacctcgtgcggtccatggtcagcgccggcagcggcgaggtggactccttcagcctggggatcctgtgcgtgtccatcatgatcgaggaggtcatgcgcagccggtggtcccgcaagatgctcatgacgggcaccctggccgtgttcctgctcctgatcatggggcagctgacctggaacgacctcatccgcctgtgcatcatggtgggcgccaacgcgagcgaccggatggggatgggcaccacgtacctggccctcatggccaccttcaagatgcgcccgatgttcgccgtcggcctgctgttccggcgcctcacctcccgggaggtgctgctgctcaccatcgggctgagcctggtggcctccgtcgagctccccaacagcctggaggagctgggcgacgggctcgcgatgggcatcatgatgctgaagctgctcacggagttccagccccaccagctgtggaccaccctgctctccctgaccttcatcaagacgaccctgagcctcgactacgcctggcgcaccatggccatggtgctgtccatcgtcagcctgttccccctctgcctgtccaccacgagccagaagaccacctggctgccggtgctcctgggctccttcgggtgcaagcccctgaccatgttcctcatcacggagaacaagatctggggccgcaagagctggcccctgaacgaggggatcatggccatcggcatcgtgtccatcctgctcagcagcctgctgaagaacgacgtccccctcgcggggccgctgatcgccggcggcatgctgatcgcctgctacgtgatctccgggagctccgccgacctcagcctggagaaggccgcggaggtgtcctgggaggaggaggccgagcacagcggcacctcccacaacatcctggtcgaggtgcaggacgacgggaccatgaagatcaaggacgaggagcgcgacgacaccctcaccatcctgctgaaggccacgctcctggccgtgagcggcgtctaccccatgtccatccccgccaccctgttcgtgtggtacttctggcagaagaagaagcagcggagcggggtgctctgggacaccccctccccgcccgaggtcgagcgcgcggtgctggacgacggcatctaccggatcctgcagcgcggcctgctcgggcggagccaggtgggcgtcggggtgttccaggacggcgtgttccacaccatgtggcacgtcacgcgcggggccgtgctgatgtaccagggcaagcggctggagccctcctgggccagcgtgaagaaggacctcatctcctacggcgggggctggcgcttccaggggagctggaacaccggcgaggaggtccaggtgatcgccgtggagcccgggaagaacccgaagaacgtccagaccacccccggcacgttcaagacccccgagggcgaggtgggggccatcgcgctggacttcaagcccggcacctccgggagcccgatcgtgaaccgggaggagaagatcgtcggcctgtacggcaacggggtggtgaccacgtccggcacctacgtcagcgccatcgcccaggccaagaccagccaggaggggcccctccccgagatcgaggacgaggtgttcaagaagcgcaacctgaccatcatggacctgcacccgggctccgggaagacgcggcgctacctccccgccatcgtgcgggaggcgatcaagcgcaagctgcgcaccctgatcctcgcccccacccgggtcgtggccagcgagatggccgaggcgctgaagggcatgcccatccgctaccagaccacggccgtgaagtccgagcacaccggccgggagatcgtcgacctgatgtgccacgccaccttcaccatgcgcctcctgagcccggtgcgggtgcccaactacaacatgatcatcatggacgaggcccacttcacggaccccgcctccatcgcggcccgcgggtacatcagcacccgggtcggcatgggggaggccgccgccatcttcatgaccgcgacgccgcccggctccgtggaggccttcccccagagcaacgccgtgatccaggacgaggagcgcgacatccccgagcggtcctggaacagcgggtacgactggatcacggacttccccggcaagaccgtctggttcgtgccctccatcaagagcggcaacgacatcgccaactgcctgcgcaagaacgggaagcgggtgatccagctctcccgcaagaccttcgacaccgagtaccagaagacgaagaacaacgactgggactacgtcgtgaccaccgacatcagcgagatgggcgccaacttccgggcggaccgcgtgatcgacccccggcgctgcctgaagcccgtcatcctgaaggacgggcccgagcgggtgatcctcgccggcccgatgcccgtgaccgtcgcctccgccgcgcagcgccgggggcgcatcggccgcaaccagaacaaggagggcgaccagtacgtgtacatggggcagcccctgaacaacgacgaggaccacgcccactggacggaggccaagatgctgctcgacaacatcaacacccccgagggcatcatcccggccctgttcgagcccgagcgggagaagtccgccgcgatcgacggggagtaccgcctgcggggcgaggcccgcaagaccttcgtcgagctcatgcggcgcggggacctgcccgtgtggctgtcctacaaggtggccagcgagggcttccagtactccgaccggcgctggtgcttcgacggcgagcggaacaaccaggtcctcgaggagaacatggacgtggagatctggaccaaggagggggagcgcaagaagctgcggccccgctggctggacgcccggacgtacagcgacccgctcgccctgcgcgagttcaaggagttcgcggccggccggcgcagcgtgtccggggacctgatcctcgagatcggcaagctgccccagcacctgaccctccgggcccagaacgccctggacaacctggtcatgctccacaacagcgagcagggcgggaaggcctaccgccacgcgatggaggagctgcccgacaccatcgagaccctgatgctcctggccctgatcgccgtgctcaccggcggggtgacgctgttcttcctgtccggcaaggggctcggcaagaccagcatcggcctgctgtgcgtcatggcctccagcgcgctcctgtggatggccaacgtggagccccactggatcgccgcctccatcatcctggagttcttcctcatggtgctgctgatcccggagcccgaccggcagcgcacgccccaggacaaccagctcgcctacgtcgtgatcgggctgctgttcatgatcctcaccgtggcggccaacgagatgggcctgctggagacgaccaagaaggacctcgggatcggccacgtcgccgccgagaaccagcagcacgccaccatgctggacgtggacctgcggccggcgagcgcctggaccctctacgccgtggccacgaccgtcatcacccccatgatgcgccacaccatcgagaacacgaccgccaacatctccctgaccgcgatcgccaaccaggccgccatcctgatggggctcgacaagggctggcccatcagcaagatggacatcggcgtgcccctgctggccctcgggtgctactcccaggtgaacccgctgaccctgacggcggccgtcctcatgctggtggcccactacgccatcatcggccccgggctgcaggcgaaggccacccgcgaggcccagaagcggaccgccgccggcatcatgaagaaccccaccgtggacgggatcgtcgcgatcgacctcgaccccgtggtgtacgacgccaagttcgagaagcagctgggccagatcatgctgctcatcctgtgcacgagccagatcctgctcatgcgcaccacctgggccctgtgcgagtccatcaccctggccacgggcccgctcaccaccctgtgggaggggagccccggcaagttctggaacaccacgatcgccgtctccatggcgaacatcttccgggggagctacctggccggcgccggcctcgccttctccctgatgaagtccctcgggggcgggcgccgggggaccggggcccagggcgagaccctcggcgagaagtggaagcgccagctgaaccagctgtccaagagcgagttcaacacctacaagcggagcgggatcatggaggtggaccgctccgaggcgaaggagggcctcaagcgcggggagacgaccaagcacgccgtgagccgcggcaccgccaagctgcggtggttcgtcgagcgcaacctggtgaagcccgaggggaaggtgatcgacctgggctgcggccgcggcgggtggtcctactactgcgccgggctcaagaaggtcaccgaggtgaaggggtacacgaagggcgggcccggccacgaggagccgatccccatggcgacctacgggtggaacctggtgaagctgtacagcggcaaggacgtcttcttcacgccgcccgagaagtgcgacaccctcctgtgcgacatcggggagtccagcccgaaccccaccatcgaggagggccgcacgctgcgggtgctcaagatggtggagccctggctgcgcgggaaccagttctgcatcaagatcctgaacccctacatgccgtccgtcgtggagaccctcgagcagatgcagcggaagcacggcggcatgctggtgcgcaaccccctgagccggaactccacccacgagatgtactgggtcagctgcgggaccggcaacatcgtgtccgccgtgaacatgacgagccgcatgctcctgaaccgcttcaccatggcccaccggaagcccacctacgagcgcgacgtcgacctgggggccggcacccggcacgtggccgtggagcccgaggtcgcgaacctcgacatcatcggccagcgcatcgagaacatcaagaacgagcacaagtccacgtggcactacgacgaggacaacccgtacaagacctgggcctaccacgggagctacgaggtgaagccctccggcagcgcctccagcatggtgaacggggtcgtgcggctgctgaccaagccctgggacgtcatccccatggtgacccagatcgccatgacggacaccaccccgttcggccagcagcgcgtgttcaaggagaaggtcgacacccggacgccccgcgccaagcgggggaccgcgcagatcatggaggtgaccgccaagtggctctggggcttcctgtcccgcaacaagaagccccggatctgcacccgcgaggagttcacgcggaaggtgcgcagcaacgccgccatcggcgccgtcttcgtggacgagaaccagtggaacagcgcgaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggtcccgggcgatctggtacatgtggctgggcgcccgcttcctcgagttcgaggccctgggcttcatgaacgaggaccactggttcagccgggagaactccttcagcggggtggagggcgaggggctgcacaagctcggctacatcctgcgcgacatctccaagatccccgggggcaacatgtacgccgacgacaccgccggctgggacacccgcatcacggaggacgacctgcagaacgaggcgaagatcaccgacatcatggagcccgagcacgccctcctggccaccagcatcttcaagctgacctaccagaacaaggtcgtgcgggtgcagcgccccgccaagaacgggacggtcatggacgtgatctcccggcgcgaccagcggggcagcggccaggtggggacctacggcctcaacaccttcaccaacatggaggtccagctgatccgccagatggagtccgaggggatcttcctgcccagcgagctcgagacgccgaacctggccgagcgggtgctggactggctcgagaagcacggcaccgagcgcctgaagcggatggcgatctccggggacgactgcgtggtcaagcccgtggacgaccgcttcgccaccgccctgatcgccctcaacgacatgggcaaggtgcggaaggacatcccccagtgggagcccagcaaggggtggaacgactggcagcaggtcccgttctgctcccaccacttccaccagctgatcatgaaggacggccgcgagatcgtggtgccctgccggaaccaggacgagctggtcggccgcgcccgggtgagccagggggcgggctggtccctccgcgagaccgcctgcctgggcaagagctacgcccagatgtggcagctgatgtacttccaccggcgcgacctccggctggccgccaacgcgatctgctccgccgtgcccgtcgactgggtgcccacgagccgcaccacctggagcatccacgcccaccaccagtggatgaccaccgaggacatgctgtccgtgtggaaccgcgtctggatcgaggagaacccgtggatggaggacaagacgcacgtgagctcctgggaggaggtgccctacctcggcaagcgggaggaccagtggtgcgggagcctgatcggcctgaccgcccgcgcgacctgggccaccaacatccaggtcgccatcaaccaggtgcggcgcctcatcggcaacgagaactacctggactacatgacgtccatgaagcggttcaagaacgagagcgaccccgagggggccctgtggtga

SEQ ID NO: 8228 - RNA, 9879 nt, synthetic construct
  misc_feature 1..9879: note = derived and/or modified CDS sequence (opt1) from DENV-1__EU482591__SS-prME
  source 1..9879: mol_type = other RNA
agcgtgaccatgctgctcatgctgctgcccaccgccctcgccttccacctgaccacccgcggcggggagccccacatgatcgtcagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctgtggtccaacggggtgctcgagagcgagatgatcatccccaagatctacggcgggccgatctcccagcacaactaccggcccggctacttcacccagaccgccgggccctggcacctgggcaagctggagctcgacttcgacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgtgagcatcatgatcgaggaggtgatgcggtcccgctggagccgcaagatgctgatgaccgggacgctcgccgtcttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtggggctcctgttccgccggctgaccagccgcgaggtcctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatggccctcagcatcgtgtccctgttccccctgtgcctcagcaccacgtcccagaagaccacctggctgccggtcctgctcgggagcttcggctgcaagcccctgaccatgttcctgatcaccgagaacaagatctgggggcggaagtcctggcccctcaacgagggcatcatggcgatcgggatcgtgagcatcctgctgtccagcctcctgaagaacgacgtgcccctggccggcccgctcatcgccggcgggatgctgatcgcctgctacgtcatcagcggctccagcgccgacctgtccctcgagaaggcggccgaggtgagctgggagcaggaggccgagcactccggggccagccactccatcctggtggaggtccaggacgacggcacgatgaagatcaaggacgaggagcgcgacgacaccctgaccatcctcctgaaggccaccctgctcgcggtgagcggggtgtaccccatgtccatccccgccacgctgttcgtctggtacttctggcagaagaagaagcagcggagcggcgtgctgtgggacaccccctccccgcccgaggtggagcgcgccgtcctcgacaacggcatctaccggatcctgcagcgcgggctgctgggccggagccaggtgggggtgggcgtcttccaggacggggtgttccacaccatgtggcacgtgacccgcggcgccgtcctcatgtaccagggcaagcggctggagccctcctgggccagcgtgaagaaggacctgatctcctacgggggcgggtggcgcttccagggcagctggaacacgggggaggaggtgcaggtcatcgcggtggagcccggcaagaacccgaagaacgtgcagaccacccccggcaccttcaagacgcccgagggggaggtcggcgccatcgccctcgacttcaagcccgggacctccggcagcccgatcgtgaaccgggagggcaagatcgtggggctgtacggcaacggggtcgtgaccacctccggcacgtacgtgagcgccatcgcccaggcgaaggccagccaggaggggcccctgcccgagatcgaggacgaggtcttcaagaagcgcaacctcaccatcatggacctgcacccgggctccggcaagacccggcgctacctgcccgccatcgtgcgggaggccatcaagcgcaagctccgcaccctgatcctggcgcccacgcgggtggtcgccagcgagatggccgaggccctcaaggggatgcccatccgctaccagaccaccgccgtgaagtccgagcacaccggccgggagatcgtggacctgatgtgccacgcgacgttcaccatgcgcctgctcagcccggtccgggtgcccaactacaacatgatcatcatggacgaggcccacttcaccgaccccgcctccatcgccgcccgcgggtacatcagcacccgggtgggcatgggggaggcggccgccatcttcatgacggccacgccgcccggctccgtcgaggccttcccccagagcaacgcggtgatccaggacgaggagcgcgacatccccgagcggtcctggaacagcggctacgactggatcaccgacttccccgggaagaccgtgtggttcgtcccctccatcaagagcggcaacgacatcgccaactgcctgcgcaagaacgggaagcgggtgatccagctgtcccgcaagacgttcgacaccgagtaccagaagaccaagaacaacgactgggactacgtggtcaccacggacatcagcgagatgggcgccaacttccgggccgaccgcgtgatcgacccccggcgctgcctcaagcccgtgatcctgaaggacgggcccgagcgggtcatcctggcgggcccgatgcccgtgaccgtcgcctccgccgcccagcgccggggccgcatcgggcgcaaccagaacaaggagggcgaccagtacgtgtacatggggcagcccctcaacaacgacgaggaccacgcccactggaccgaggcgaagatgctgctggacaacatcaacacccccgagggcatcatcccggccctcttcgagcccgagcgggagaagtccgccgccatcgacggggagtaccgcctgcggggcgaggcccgcaagacgttcgtggagctgatgcggcgcggcgacctccccgtctggctgtcctacaaggtggcgagcgaggggttccagtactccgaccggcgctggtgcttcgacggcgagcggaacaaccaggtgctggaggagaacatggacgtcgagatctggaccaaggagggggagcgcaagaagctccggccccgctggctggacgcccggacctacagcgacccgctggccctccgcgagttcaaggagttcgccgccggccggcgcagcgtgtccggcgacctgatcctggagatcgggaagctcccccagcacctgaccctgcgggcgcagaacgccctcgacaacctggtgatgctgcacaacagcgagcagggcgggaaggcctaccgccacgccatggaggagctccccgacaccatcgagacgctgatgctgctcgcgctgatcgccgtcctgaccggcggggtgaccctcttcttcctgtccggcaagggcctggggaagaccagcatcggcctcctgtgcgtgacggcctccagcgccctgctctggatggcctccgtcgagccccactggatcgcggccagcatcatcctggagttcttcctgatggtgctcctgatcccggagcccgaccggcagcgcacgccccaggacaaccagctggcctacgtggtcatcgggctcctgttcatgatcctgaccgtggccgccaacgagatgggcctcctggagaccacgaagaaggacctggggatcggctacgtggcggccgagaaccaccagcacgccaccatgctcgacgtcgacctgcacccggcctccgcctggaccctgtacgcggtggccaccacggtgatcacccccatgatgcggcacaccatcgagaacaccacggccaacatcagcctcaccgccatcgccaaccaggcggccatcctgatgggcctggacaaggggtggcccatctccaagatggacatcggcgtccccctcctggccctggggtgctacagccaggtgaacccgctcaccctgaccgccgcggtgctgatgctcgtcgcccactacgccatcatcggccccgggctgcaggccaaggccacgcgcgaggcgcagaagcgcaccgccgccggcatcatgaagaaccccaccgtggacggcatcgtggccatcgacctggaccccgtcgtgtacgacgccaagttcgagaagcagctcgggcagatcatgctgctgatcctctgcacctcccagatcctgctgatgcggacgacctgggcgctctgcgagagcatcaccctggccaccggcccgctgacgaccctctgggaggggtcccccggcaagttctggaacaccaccatcgccgtgagcatggccaacatcttccgcggctcctacctggccggggcgggcctggccttcagcctcatgaagtccctcgggggcgggcggcgcggcacgggcgcccagggggagaccctgggcgagaagtggaagcggcagctcaaccagctgagcaagagcgagttcaacacctacaagcgctccgggatcatggaggtcgaccggagcgaggccaaggagggcctgaagcgcggggagaccacgaagcacgcggtgtcccggggcaccgccaagctccgctggttcgtggagcggaacctggtcaagcccgagggcaaggtgatcgacctggggtgcggccgcgggggctggagctactactgcgccgggctgaagaaggtgaccgaggtcaagggctacaccaagggcgggcccggccacgaggagccgatccccatggccacctacgggtggaacctcgtgaagctgcactccggcaaggacgtgttcttcatgccgcccgagaagtgcgacacgctgctctgcgacatcggggagagctccccgaaccccaccatcgaggagggccggaccctgcgcgtcctgaagatggtggagccctggctccggggcaaccagttctgcatcaagatcctgaacccctacatgccgagcgtggtcgagaccctggagcgcatgcagcggaagcacgggggcatgctcgtgcgcaaccccctgtcccggaacagcacgcacgagatgtactgggtgtcctgcgggaccggcaacatcgtcagcgccgtgaacatgacctcccgcatgctgctcaaccgcttcaccatggcgcaccggaagcccacgtacgagcgcgacgtggacctgggcgccgggacccggcacgtcgccgtggagcccgaggtggccaacctggacatcatcggccagcgcatcgagaacatcaagaacgagcacaagagcacctggcactacgacgaggacaacccgtacaagacctgggcctaccacgggtcctacgaggtcaagcccagcggctccgcgagctccatggtgaacggggtcgtgcggctcctgacgaagccctgggacgtgatccccatggtcacccagatcgccatgaccgacaccacgccgttcggccagcagcgcgtgttcaaggagaaggtggacacccggacgccccgcgccaagcggggcaccacgcagatcatggaggtcaccgccaagtggctgtgggggttcctcagccgcaacaagaagccccggatctgcacccgcgaggagttcacccggaaggtgcgcagcaacgccgcgatcggcgccgtgttcgtcgacgagaaccagtggaactccgccaaggaggccgtggaggacgagcggttctgggacctggtgcaccgcgagcgggagctgcacaagcaggggaagtgcgcgacgtgcgtctacaacatgatgggcaagcgcgagaagaagctcggggagttcggcaaggccaagggcagccgggccatctggtacatgtggctgggggcccgcttcctggagttcgaggccctcggcttcatgaacgaggaccactggttctcccgggagaacagcctgtccggggtggagggcgaggggctgcacaagctcggctacatcctgcgcgacatcagcaagatcccgggcgggaacatgtacgcggacgacaccgccggctgggacacccgcatcaccgaggacgacctgcagaacgaggccaagatcacggacatcatggagcccgagcacgccctcctggccacctccatcttcaagctgacctaccagaacaaggtggtccgggtgcagcgccccgcgaagaacgggaccgtgatggacgtcatcagccggcgcgaccagcggggctccggccaggtggggacgtacggcctcaacaccttcaccaacatggaggtgcagctgatccgccagatggagagcgaggggatcttcctgccctccgagctcgagaccccgaacctggccgagcgggccctggactggctcgagaagcacggcgccgagcgcctgaagcggatggccatcagcggggacgactgcgtcgtgaagcccatcgacgaccgcttcgcgacggccctgaccgccctcaacgacatgggcaaggtgcggaaggacatcccccagtgggagccctccaagggctggaacgactggcagcaggtcccgttctgcagccaccacttccaccagctgatcatgaaggacgggcgcgagatcgtggtgccctgccggaaccaggacgagctggtcggccgcgcccgggtgtcccagggggccggctggagcctccgcgagaccgcgtgcctggggaagtcctacgcccagatgtggcagctgatgtacttccaccggcgcgacctccggctggccgccaacgcgatctgcagcgccgtgcccgtcgactgggtgcccaccagccgcaccacgtggtccatccacgcccaccaccagtggatgaccaccgaggacatgctgagcgtgtggaaccgcgtctggatcgaggagaacccgtggatggaggacaagacccacgtgtccagctgggaggaggtgccctacctcggcaagcgggaggaccagtggtgcggctccctgatcgggctgacggcccgcgccacctgggcgaccaacatccaggtcgccatcaaccaggtgcggcgcctcatcggcaacgagaactacctggactacatgaccagcatgaagcggttcaagaacgagtccgacagcgagggggccctgtggtga

SEQ ID NO: 8229 - RNA, 9879 nt, synthetic construct
  misc_feature 1..9879: note = derived and/or modified CDS sequence (opt1) from DENV-1__EU482592__SS-prME
  source 1..9879: mol_type = other RNA
agcgtgaccatgctgctcatgctgctgcccaccgccctcgccttccacctgaccacccggggcggggagccccacatgatcgtgtccaagcaggagcggggcaagagcctcctgttcaagacctccgccgggatcaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtcgccctggcgccccacgtgggcctggggctcgagacccgcaccgagacctggatgagctccgagggcgcctggaagcagatccagaaggtggagacctgggccctgcggcaccccgggttcacggtcaccgccctgttcctcgcgcacgccatcggcaccagcatcacccagaaggggatcatcttcatcctgctgatgctcgtgacgccctccatggccatgcgctgcgtgggcatcggcaaccgggacttcgtcgaggggctgagcggcgccacctgggtggacgtggtcctggagcacgggtcctgcgtgaccaccatggccaaggacaagcccacgctcgacatcgagctgctgaagaccgaggtgaccaaccccgcggtcctccgcaagctgtgcatcgaggccaagatcagcaacaccacgaccgactcccggtgcccgacccagggcgaggccaccctggtggaggagcaggacagcaacttcgtgtgccgccggacgttcgtcgaccgcggctgggggaacggctgcggcctcttcggcaaggggtccctgctgacctgcgccaagttcaagtgcgtgaccaagctcgagggcaagatcgtgcagtacgagaacctgaagtacagcgtcatcgtgaccgtgcacacgggcgaccagcaccaggtcgggaacgagaccaccgagcacggcaccatcgccaccatcacgccccaggcgcccacctccgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggaccagcggggccagcacctcccaggagacgtggaaccgccaggacctcctggtgaccttcaagaccgcccacgccaagaagcaggaggtggtcgtgctgggcagccaggagggcgcgatgcacaccgccctcacgggggccaccgagatccagacctccggcaccacgaccatcttcgccgggcacctgaagtgccggctgaagatggacaagctcaccctgaagggcatgagctacgtgatgtgcaccgggtccttcaagctggagaaggaggtcgccgagacgcagcacggcaccgtgctggtgcaggtcaagtacgagggcaccgacgcgccctgcaagatccccttcagcgcccaggacgagaagggggtgacccagaacggccgcctcatcacggccaacccgatcgtgaccgacaaggagaagcccgtcaacatcgagaccgagccgcccttcggggagtcctacatcgtggtgggcgccggcgagaaggcgctgaagctgagctggttcaagaaggggtccagcatcggcaagatgttcgaggccaccgcccgcggggcccgccggatggccatcctcggcgacacggcgtgggacttcgggtccatcggcggcgtcttcaccagcgtggggaagctggtgcaccaggtcttcggcgccgcctacggggtgctgttctccggcgtgagctggaccatgaagatcgggatcggcatcctcctgacctggctgggcctcaactcccgcagcacgtccctgagcatgacctgcatcgccgtcgggatggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggcggacagcccgaagcggctgtccgccgccatcggcaaggcctgggaggagggggtgtgcggcatccgcagcgccacccggctcgagaacatcatgtggaagcagatctccaacgagctgaaccacatcctgctcgagaacgacatgaagttcaccgtggtcgtgggggacgcgaacggcatcctggcccaggggaagaagatgatccgcccccagcccatggagcaccggtacagctggaagtcctggggcaaggccaagatcatcggcgccgacatccagaacagcaccttcatcatcgacgggcccgacacgccggagtgccccgacgaccagcgcgcgtggaacatctgggaggtggaggactacggcttcgggatcttcaccaccaacatctggctgaagctccgggactcctacacccagatgtgcgaccaccgcctgatgagcgccgccatcaaggactccaaggccgtccacgccgacatgggctactggatcgagagcgagaagaacgagacgtggaagctggcgcgggcctccttcatcgaggtgaagacctgcatctggcccaagagccacaccctctggtccaacggcgtgctggagagcgagatgatcatccccaagatctacgggggcccgatctcccagcacaactaccgccccgggtacttcacccagacggccggcccctggcacctggggaagctcgagctggacttcgacctgtgcgagggcaccaccgtcgtggtggacgagcactgcggcaaccgggggccgagcctccgcaccacgaccgtcaccggcaagatcatccacgagtggtgctgccggtcctgcaccctgccgcccctgcgcttccgcggggaggacggctgctggtacgggatggagatccgccccgtgaaggagaaggaggagaacctcgtgcggagcatggtcagcgccggctccggcgaggtggacagcttctccctggggatcctgtgcgtgagcatcatgatcgaggaggtcatgcgctcccggtggagccgcaagatgctcatgacgggcaccctggccgtgttcctgctcctgatcatggggcagctgacctggaacgacctcatccgcctgtgcatcatggtgggcgcgaacgcctccgaccggatggggatgggcaccacgtacctggccctcatggccaccttcaagatgcgcccgatgttcgccgtcgggctgctgttccggcgcctcaccagccgggaggtgctgctgctcaccatcgggctgtccctggtggcgagcgtcgagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcctggcgcaccatggccatggtgctgagcatcgtctccctgttccccctctgcctgagcaccacgtcccagaagaccacctggctgccggtgctcctgggcagcttcgggtgcaagcccctgaccatgttcctcatcacggagaacaagatctggggccggaagtcctggcccctgaacgaggggatcatggcgatcggcatcgtgagcatcctgctcagctccctgctgaagaacgacgtccccctcgccgggccgctgatcgccggcggcatgctgatcgcctgctacgtgatcagcgggtccagcgccgacctctccctggagaaggcggccgaggtgagctgggaggaggaggccgagcactccggcaccagccacaacatcctggtcgaggtgcaggacgacgggaccatgaagatcaaggacgaggagcgcgacgacaccctcaccatcctgctgaaggccacgctcctggccgtgtccggcgtctaccccatgagcatccccgcgaccctgttcgtgtggtacttctggcagaagaagaagcagcggtccggggtgctctgggacacccccagcccgcccgaggtcgagcgcgccgtgctggacgacggcatctaccggatcctgcagcgcggcctgctcgggcggtcccaggtgggcgtcggggtgttccaggacggcgtgttccacaccatgtggcacgtcacgcgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagaccacccccggcacgttcaagacccccgagggcgaggtgggggcgatcgccctggacttcaagcccggcaccagcgggtccccgatcgtgaaccgggagggcaagatcgtcggcctgtacgggaacggcgtggtgaccacgagcgggacctacgtcagcgccatcgcccaggccaagacctcccaggagggccccctccccgagatcgaggaggaggtgttcaagaagcgcaacctgaccatcatggacctgcacccggggagcggcaagacgcggcgctacctccccgcgatcgtgcgggaggccatcaagcgcaagctgcgcaccctgatcctcgcccccacccgggtcgtggcctccgagatggcggaggccctgaagggcatgcccatccgctaccagaccacggccgtcaagagcgagcacaccgggcgggagatcgtcgacctgatgtgccacgccaccttcaccatgcgcctcctgtccccggtgcgggtgcccaactacaacatgatcatcatggacgaggcccacttcacggaccccgcgagcatcgccgcccgcggctacatctccacccgggtcgggatgggcgaggccgccgcgatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgccaactgcctgcgcaagaacggcaagcgggtgatccagctcagccgcaagaccttcgacaccgagtaccagaagacgcggaacaacgactgggactacgtcgtgaccaccgacatctccgagatgggggcgaacttccgcgccgaccgggtgatcgacccccgccggtgcctgaagcccgtcatcctgaaggacggccccgagcgcgtgatcctcgccgggccgatgcccgtgaccgtcgccagcgcggcccagcggcgcggccgcatcggccggaaccagaacaaggagggggaccagtacgtgtacatgggccagcccctgaacaacgacgaggaccacgcccactggacggaggccaagatgctgctcgacaacatcaacacccccgaggggatcatcccggccctgttcgagcccgagcgcgagaagtccgcggccatcgacggcgagtaccggctgcgcggggaggcccggaagaccttcgtcgagctcatgcgccggggcgacctgcccgtgtggctgagctacaaggtggcctccgagggcttccagtacagcgaccgccggtggtgcttcgacggggagcgcaacaaccaggtcctcgaggagaacatggacgtggagatctggaccaaggagggcgagcggaagaagctgcgcccccggtggctggacgcccgcacgtacagcgacccgctcgcgctgcgggagttcaaggagttcgccgccgggcgccggtccgtgagcggcgacctgatcctcgagatcggcaagctgccccagcacctgaccctccgcgcccagaacgccctggacaacctggtcatgctccacaactccgagcagggcgggaaggcgtaccggcacgccatggaggagctgcccgacaccatcgagaccctgatgctcctggccctgatcgccgtgctcaccgggggcgtgacgctgttcttcctgagcgggaagggcctcggcaagacctccatcgggctgctgtgcgtcatggcgagctccgccctcctgtggatggccaacgtggagccccactggatcgccgccagcatcatcctggagttcttcctcatggtgctgctgatcccggagcccgaccgccagcggacgccccaggacaaccagctcgcgtacgtcgtgatcggcctgctgttcatgatcctcaccgtggccgccaacgagatggggctgctggagacgaccaagaaggacctcggcatcgggtacgtcgccgccgagaaccagcaccacgcgaccatgctggacgtggacctgcgcccggcctccgcctggaccctctacgccgtggccacgaccgtcatcacccccatgatgcgccacaccatcgagaacacgaccgcgaacatcagcctgaccgccatcgccaaccaggccgccatcctgatgggcctcgacaagggctggcccatctccaagatggacatcggggtgcccctgctggcgctcggctgctacagccaggtgaacccgctgaccctgacggccgccgtcctcatgctggtggcccactacgcgatcatcgggcccggcctgcaggccaaggccacccgggaggcccagaagcgcaccgccgcggggatcatgaagaaccccaccgtggacggcatcgtcgccatcgacctcgaccccgtggtgtacgacgccaagttcgagaagcagctgggccagatcatgctgctcatcctgtgcacgtcccagatcctgctcatgcggaccacctgggccctgtgcgagagcatcaccctggccacggggccgctcaccaccctgtgggagggctcccccgggaagttctggaacaccacgatcgcggtcagcatggccaacatcttccgcggctcctacctggccggcgccgggctcgccttcagcctgatgaagtccctgggcgggggccggcgcgggaccggcgcgcagggcgagaccctcggggagaagtggaagcggcagctgaaccagctgagcaagagcgagttcaacacctacaagcgctccggcatcatggaggtggaccggagcgaggccaaggaggggctcaagcgcggcgagacgaccaagcacgccgtgtcccgggggaccgccaagctgcgctggttcgtcgagcggaacctggtgaagcccgagggcaaggtgatcgacctgggctgcgggcgcggcgggtggagctactactgcgcgggcctcaagaaggtcaccgaggtgaaggggtacacgaagggcggccccgggcacgaggagccgatccccatggccacctacggctggaacctggtgaagctgtactccgggaaggacgtcttcttcacgccgcccgagaagtgcgacaccctcctgtgcgacatcggcgagagctccccgaaccccaccatcgaggaggggcggacgctgcgcgtgctcaagatggtggagccctggctgcggggcaaccagttctgcatcaagatcctgaacccctacatgccgagcgtcgtggagaccctcgagcagatgcagcgcaagcacggcgggatgctggtgcggaaccccctgtcccgcaacagcacccacgagatgtactgggtctcctgcggcaccgggaacatcgtgagcgccgtgaacatgacgtcccgcatgctcctgaaccggttcaccatgacccaccgcaagcccacctacgagcgggacgtcgacctgggcgccggcacgcgccacgtggccgtggagcccgaggtcgcgaacctcgacatcatcgggcagcggatcgagaacatcaagaacgagcacaagagcacctggtactacgacgaggacaacccgtacaagacctgggcctaccacggctcctacgaggtgaagcccagcgggtccgccagctccatggtgaacggcgtcgtgcgcctgctgaccaagccctgggacgtcatccccatggtgacgcagatcgccatgaccgacaccaccccgttcgggcagcagcgggtgttcaaggagaaggtcgacacgcgcacgccccgggccaagcgcggcaccgcgcagatcatggaggtgaccgccaagtggctctggggcttcctgagccggaacaagaagccccgcatctgcacgcgggaggagttcacccgcaaggtgcggagcaacgccgccatcggggccgtcttcgtggacgagaaccagtggaactccgcgaaggaggccgtggaggacgagcgcttctgggacctggtccaccgggagcgcgagctccacaagcagggcaagtgcgcgacctgcgtgtacaacatgatggggaagcgggagaagaagctgggcgagttcgggaaggccaagggcagccgcgcgatctggtacatgtggctgggcgcccggttcctcgagttcgaggccctggggttcatgaacgaggaccactggttctcccgcgagaacagcttctccggcgtggagggggagggcctgcacaagctcgggtacatcctgcgcgacatcagcaagatcccgggcggcaacatgtacgccgacgacaccgccgggtgggacacgcggatcaccgaggacgacctgcagaacgaggcgaagatcaccgacatcatggagcccgagcacgccctcctggccacctccatcttcaagctgacgtaccagaacaaggtcgtgcgcgtgcagcggcccgccaagaacggcaccgtcatggacgtgatcagccgccgggaccagcgcgggtccggccaggtgggcacctacgggctcaacaccttcacgaacatggaggtccagctgatccggcagatggagagcgagggcatcttcctgccctccgagctcgagaccccgaacctggccgagcgcgtgctgaactggctcgagaagcacgggaccgagcggctgaagcgcatggcgatcagcggcgacgactgcgtggtcaagcccgtggacgaccggttcgccaccgccctgatcgccctcaacgacatggggaaggtgcgcaaggacatcccccagtgggagccctccaagggctggaacgactggcagcaggtcccgttctgcagccaccacttccaccagctgatcatgaaggacggccgggagatcgtggtgccctgccgcaaccaggacgagctggtcgggcgggcccgcgtgtcccagggcgcggggtggagcctccgggagacggcctgcctgggcaagtcctacgcccagatgtggcagctgatgtacttccaccgccgggacctccgcctggccgccaacgcgatctgcagcgccgtgcccgtcgactgggtgcccaccagccgcaccacctggtccatccacgcccaccaccagtggatgaccacggaggacatgctgagcgtgtggaaccgggtctggatcgaggagaacccgtggatggaggacaagacccacgtgtccagctgggaggaggtgccctacctcgggaagcgcgaggaccagtggtgcggctccctgatcggcctgaccgcccgggcgacctgggccacgaacatccaggtcgccatcaaccaggtgcgccggctcatcgggaacgagaactacctggactacatgaccagcatgaagcgcttcaagaacgagtccgaccccgagggcgccctgtggtga

SEQ ID NO: 8230 - RNA, 9879 nt, synthetic construct
  misc_feature 1..9879: note = derived and/or modified CDS sequence (opt1) from DENV-1__EU482609__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacctacctggccctcatggccacgttcaagatgcgcccgatgttcgccgtggggctgctgttccggcgcctcaccagccgggaggtgctgctgctcaccatcggcctgtccctggtcgccagcgtggagctccccaactccctggaggagctgggggacggcctcgcgatgggcatcatgatgctgaagctgctcaccgagttccagccccaccagctgtggacgaccctgctcagcctgaccttcgtcaagaccacgctgtccctcgactacgcctggaagaccaccgccatggtgctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcacgatgaagatcaaggacgaggagcgggacgacaccctcaccatcctgctgaaggccaccctcctggccgtgtccggggtgtaccccatgagcatccccgcgacgctgttcgtctggtacttctggcagaagaagaagcagcgctccggcgtgctctgggacacccccagcccgcccgaggtggagcgggccgtcctggacgacggcatctaccgcatcctgcagcgggggctgctcggccgctcccaggtgggggtgggcgtcttccaggacggggtgttccacaccatgtggcacgtgacccggggcgccgtcctgatgtaccagggcaagcgcctggagcccagctgggcctccgtgaagaaggacctcatcagctacgggggcgggtggcggttccagggctcctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggaccagcggctccccgatcgtgaaccgcgagggcaagatcgtggggctgtacggcaacggggtcgtgaccaccagcggcacgtacgtgtccgccatcgcccaggcccgggcgagccaggaggggcccctccccgagatcgaggacgaggtcttcaagaagcgcaacctgaccatcatggacctgcacccgggcagcggcaagacccggcgctacctccccgccatcgtgcgggaggccatcaagcgcaagctgcgcaccctgatcctcgcccccacgcgggtggtcgcgtccgagatggccgaggccctgaaggggatgcccatccgctaccagaccaccgccgtcaagagcgagcacaccggccgggagatcgtggacctgatgtgccacgccacgttcaccatgcgcctcctgtccccggtccgggtgcccaactacaacatgatcatcatggacgaggcgcacttcaccgaccccgccagcatcgccgcccgcgggtacatctccacccgggtgggcatgggggaggccgcggccatcttcatgacggccacgccgcccggcagcgtcgaggccttcccccagtccaacgccgtgatccaggacgaggagcgcgacatccccgagcggagctggaactccggctacgactggatcaccgacttccccgggaagaccgtgtggttcgtccccagcatcaagtccggcaacgacatcgcgaactgcctgcgcaagaacgggaagcgggtgatccagctcagccgcaagacgttcgacaccgagtaccagaagaccaagaacaacgactgggactacgtggtcaccacggacatctccgagatgggcgccaacttccgggccgaccgcgtgatcgacccccggcgctgcctgaagcccgtgatcctgaaggacgggcccgagcgggtcatcctcgccggcccgatgcccgtgaccgtcgcgagcgccgcccagcgccggggccgcatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgggagaagtccgccgccatcgacggggagtaccgcctgcggggcgaggcccgcaagacgttcgtggagctcatgcggcgcggcgacctgcccgtctggctgagctacaaggtggcctccgaggggttccagtacagcgaccggcgctggtgcttcgacggcgagcggaacaaccaggtgctcgaggagaacatggacgtcgagatctggaccaaggagggggagcgcaagaagctgcggccccgctggctggacgcgcggacctactccgacccgctcgccctgcgcgagttcaaggagttcgccgccggccggcgcagcgtgagcggcgacctgatcctcgagatcgggaagctgccccagcacctgaccctccgggcccagaacgcgctggacaacctggtgatgctccacaactccgagcagggcgggaaggcctaccgccacgccatggaggagctgcccgacaccatcgagacgctgatgctcctggccctgatcgcggtcctcaccggcggggtgaccctgttcttcctgagcggcaagggcctcgggaagacctccatcggcctgctgtgcgtgacggccagctccgccctcctgtggatggccagcgtcgagccccactggatcgccgcgtccatcatcctggagttcttcctcatggtgctgctgatcccggagcccgaccggcagcgcacgccccaggacaaccagctcgcctacgtggtcatcgggctgctgttcatgatcctcaccgtggccgccaacgagatgggcctgctggagaccacgaagaaggacctcgggatcggctacgtggccgcggagaaccaccagcacgccaccatgctggacgtcgacctgcggccggccagcgcctggaccctctacgccgtggcgaccacggtgatcacccccatgatgcgccacaccatcgagaacaccacggccaacatctccctgaccgccatcgccaaccaggccgcgatcctgatgggcctcgacaaggggtggcccatcagcaagatggacatcggcgtccccctgctggccctcgggtgctactcccaggtgaacccgctgaccctgaccgccgccgtgctcatgctggtcgcgcactacgccatcatcggccccgggctgcaggccaaggccacgcgcgaggcccagaagcggaccgcggccggcatcatgaagaaccccaccgtggacggcatcgtggccatcgacctcgaccccgtcgtgtacgacgccaagttcgagaagcagctggggcagatcatgctgctcatcctgtgcaccagccagatcctgctcatgcgcacgacctgggccctgtgcgagtccatcaccctggcgaccggcccgctcacgaccctgtgggaggggagccccggcaagttctggaacaccaccatcgccgtgtccatggccaacatcttccggggcagctacctggccggggccggcctcgcgttctccctgatgaagtccctcgggggcgggcgccgggggacgggcgcccagggggagaccctcggcgagaagtggaagcgccagctgaaccagctgtccaagagcgagttcaacacctacaagcggagcgggatcatggaggtcgaccgctccgaggccaaggagggcctcaagcgcggggagaccacgaagcacgccgtgagccgcggcaccgcgaagctgcggtggttcgtggagcgcaacctggtcaagcccgagggcaaggtgatcgacctggggtgcggccgcgggggctggtcctactactgcgccgggctcaagaaggtgaccgaggtcaagggctacaccaagggcgggcccggccacgaggagccgatccccatggccacctacgggtggaacctggtgaagctgcacagcggcaaggacgtgttcttcatgccgcccgagaagtgcgacacgctcctgtgcgacatcggggagtccagcccgaaccccaccatcgaggagggccgcaccctgcgggtcctcaagatggtggagccctggctgaagggcaaccagttctgcatcaagatcctgaacccctacatgccgtccgtggtcgagaccctcgagcagatgcagcgcaagcacgggggcatgctggtgcggaaccccctgagccgcaactccacgcacgagatgtactgggtgagctgcgggaccggcaacatcgtctccgccgtgaacatgaccagccggatgctcctgaaccgcttcaccatggcccaccgcaagcccacgtacgagcgggacgtggacctgggcgcggggacccgccacgtcgccgtggagcccgaggtggccaacctcgacatcatcggccagcggatcgagaacatcaagaacgagcacaagtccacctggcactacgacgaggacaacccgtacaagacctgggcctaccacgggagctacgaggtcaagccctccggcagcgcctccagcatggtgaacggggtcgtgcgcctgctgacgaagccctgggacgtgatccccatggtcacccagatcgcgatgaccgacaccacgccgttcggccagcagcgggtgttcaaggagaaggtggacacccgcacgccccgggccaagcgcggcaccacgcagatcatggaggtcaccgcccggtggctctgggggttcctgtcccgcaacaagaagccccggatctgcacccgcgaggagttcacccggaaggtgcgcagcaacgccgccatcggcgcggtgttcgtcgacgagaaccagtggaacagcgccaaggaggccgtggaggacgagcggttctgggacctggtgcaccgcgagcgggagctccacaagcaggggaagtgcgccacgtgcgtctacaacatgatgggcaagcgcgagaagaagctgggggagttcggcaaggcgaagggctcccgggccatctggtacatgtggctgggggcccgcttcctcgagttcgaggccctgggcttcatgaacgaggaccactggttcagccgggagaactccctgagcggggtggagggcgaggggctccacaagctgggctacatcctgcgcgacatctccaagatcccgggcgggaacatgtacgccgacgacaccgcgggctgggacacccgcatcaccgaggacgacctccagaacgaggccaagatcacggacatcatggagcccgagcacgccctgctggccaccagcatcttcaagctcacctaccagaacaaggtggtccgggtgcagcgccccgccaagaacgggaccgtgatggacgtcatctcccggcgcgaccagcggggcagcggccaggtggggacgtacggcctgaacaccttcaccaacatggaggtgcagctgatccgccagatggagtccgaggggatcttcagcccctccgagctcgagaccccgaacctggcggagcgggtcctggactggctcgagaagcacggcgccgagcgcctgaagcggatggccatcagcggggacgactgcgtggtgaagcccatcgacgaccgcttcgccacggccctgaccgcgctcaacgacatgggcaaggtccggaaggacatcccccagtgggagccctccaagggctggaacgactggcagcaggtcccgttctgcagccaccacttccaccagctgatcatgaaggacgggcgcgagatcgtggtcccctgccggaaccaggacgagctggtgggccgcgcccgggtgtcccagggggccggctggagcctccgcgagaccgcctgcctggggaagtcctacgcccagatgtggcagctgatgtacttccaccggcgcgacctccggctggcggccaacgccatctgcagcgccgtccccgtggactgggtgcccaccagccgcaccacgtggtccatccacgcgcaccaccagtggatgaccaccgaggacatgctgagcgtctggaaccgcgtgtggatcgaggagaacccgtggatggaggacaagacccacgtgtccagctgggaggaggtcccctacctcggcaagcgggaggaccagtggtgcggctccctgatcgggctgacggcccgcgccacctgggccaccaacatccaggtggccatcaaccaggtgcggcgcctcatcggcaacgagaactacctggactacatgaccagcatgaagcggttcaagaacgagtccgaccccgagggggcgctgtggtga

SEQ ID NO: 8231 - RNA, 9879 nt, synthetic construct
  misc_feature 1..9879: note = derived and/or modified CDS sequence (opt1) from DENV-1__EU482610__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtggagacctgggtgctgcgccaccccgggttcacggtgatcgccttcttcctggcccacgcgatcggcaccagcatcacccagaaggggatcatcttcatcctcctgatgctggtcaccccctccatggccatgcggtgcgtgggcatcggcaaccgcgacttcgtggaggggctcagcggcgccacgtgggtcgacgtggtgctggagcacgggtcctgcgtcaccaccatggccaagaacaagcccaccctggacatcgagctcctgaagacggaggtgaccaaccccgccgtgctgcggaagctctgcatcgaggcgaagatcagcaacaccaccacggactcccgctgcccgacccagggcgaggccaccctggtcgaggagcaggacgccaacttcgtgtgccggcgcaccttcgtggaccggggctgggggaacggctgcgggctgttcggcaaggggagcctcctgacgtgcgccaagttcaagtgcgtcaccaagctggagggcaagatcgtgcagtacgagaacctcaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctgaccctcgactgcagcccccggaccggcctggacttcaacgagatggtgctgctcacgatgaaggagaagtcctggctggtgcacaagcagtggttcctggacctcccgctgccctggacctccggggccagcaccagccaggagacctggaaccggcaggacctgctcgtcacgttcaagaccgcccacgccaagaagcaggaggtggtggtcctgggctcccaggagggcgcgatgcacaccgccctgaccggggccacggagatccagaccagcggcaccaccacgatcttcgccgggcacctcaagtgccgcctgaagatggacaagctgaccctcaagggcatgtcctacgtgatgtgcaccgggagcttcaagctggagaaggaggtggccgagacccagcacggcacggtcctggtccaggtgaagtacgagggcaccgacgcgccctgcaagatccccttctccacccaggacgagaagggggtcacccagaacggccggctgatcacggccaacccgatcgtgaccgacaaggagaagcccgtgaacatcgagaccgagccgcccttcggggagagctacatcgtcgtgggcgccggcgagaaggccctcaagctgtcctggttcaagcgcgggagctccatcggcaagatgttcgaggcgaccgcccgcggggcccgccgcatggccatcctgggcgacacggcctgggacttcgggagcatcggcggcgtgttcacctccgtcgggaagctcgtgcaccaggtgttcggcaccgcgtacggggtcctgttcagcggcgtgtcctggaccatgaagatcgggatcggcatcctgctcacgtggctgggcctgaacagccggtccaccagcctctccatgacctgcatcgccgtggggatggtcaccctgtacctgggcgtgatggtgcaggccgacagcgggtgcgtcatcaactggaagggccgcgagctcaagtgcgggtccggcatcttcgtgacgaacgaggtgcacacctggaccgagcagtacaagttccaggccgacagcccgaagcggctgagcgccgcgatcggcaaggcctgggaggagggggtctgcggcatccgctccgccacccggctggagaacatcatgtggaagcagatcagcaacgagctcaaccacatcctgctggagaacgacatgaagctcaccgtggtggtcggggacgccaacggcatcctggcccaggggaagaagatgatccgcccccagcccatggagcacaagtactcctggaagtcctggggcaaggcgaagatcatcggcgccgacatccagaacacgaccttcatcatcgacgggcccgacaccccggagtgccccgacggccagcgggcctggaacatctgggaggtggaggactacgggttcggcgtgttcaccacgaacatctggctgaagctccgcgactcctacacccagatgtgcgaccaccggctgatgagcgccgcgatcaaggactccaaggccgtccacgccgacatgggctactggatcgagagcgagaagaacgagacctggaagctggcccgcgcctccttcatcgaggtgaagacctgcacgtggcccaagagccacaccctctggtccaacggggtgctggagagcgagatgatcatccccaagatctacggcgggccgatctcccagcacaactaccggcccggctacttcacccagaccgcggggccctggcacctgggcaagctcgagctggacttcgacctgtgcgagggcacgaccgtcgtggtggacgagcactgcgggaaccgcggcccgagcctccggaccaccacggtcaccgggaagatcatccacgagtggtgctgccgctcctgcaccctgccgcccctgcggttccgcggcgaggacgggtgctggtacggcatggagatccggcccgtgaaggagaaggaggagaacctcgtgcgcagcatggtctccgccggcagcggggaggtggacagcttctccctgggcatcctgtgcgtgagcatcatgatcgaggaggtcatgcggtcccgctggagccgcaagatgctcatgaccgggacgctggccgtgttcctgctcctgatcatgggccagctgacctggaacgacctcatccggctgtgcatcatggtgggggccaacgcctccgaccgcatgggcatgggcaccacctacctggcgctcatggccacgttcaagatgcggccgatgttcgccgtcgggctgctgttccgccggctcaccagccgcgaggtgctgctgctcaccatcggcctgtccctggtcgccagcgtggagctccccaactccctggaggagctgggggacggcctcgccatgggcatcatgatgctgaagctgctcaccgagttccagccccaccagctgtggacgaccctgctcagcctgaccttcgtgaagaccacgctgtccctcgactacgcgtggaagaccaccgccatggtcctgagcatcgtgtccctgttccccctctgcctgagcaccacgtcccagaagaccacctggctgccggtgctcctggggagcttcggctgcaagcccctgaccatgttcctcatcaccgagaacaagatctgggggcggaagtcctggcccctgaacgagggcatcatggccatcgggatcgtcagcatcctgctctccagcctgctgaagaacgacgtgcccctcgccggcccgctgatcgcgggcgggatgctgatcgcctgctacgtgatcagcggctccagcgccgacctctccctggagaaggccgccgaggtcagctgggagcaggaggcggagcactccggggccagccacaacatcctggtggaggtgcaggacgacggcacgatgaagatcaaggacgaggagcgcgacgacaccctcaccatcctgctgaaggccaccctcctggccgtctccggggtgtaccccatgagcatccccgccacgctgttcgtgtggtacttctggcagaagaagaagcagcggtccggcgtcctctgggacacccccagcccgcccgaggtggagcgcgcggtgctggacgacggcatctaccggatcctgcagcgcgggctgctcggccggtcccaggtcggggtgggcgtgttccaggacggggtcttccacaccatgtggcacgtgacccgcggcgccgtgctgatgtaccagggcaagcggctggagcccagctgggcctccgtcaagaaggacctcatcagctacgggggcgggtggcgcttccagggctcctggaacacgggggaggaggtccaggtgatcgccgtcgagcccggcaagaacccgaagaacgtgcagaccacccccggcaccttcaagacgcccgagggggaggtgggcgccatcgcgctggacttcaagcccgggaccagcggctccccgatcgtcaaccgggagggcaagatcgtggggctgtacggcaacggggtggtcaccaccagcggcacgtacgtgtccgccatcgcccaggccaaggccagccaggaggggcccctccccgagatcgaggacgaggtgttcaagaagcgcaacctgaccatcatggacctgcacccgggcagcggcaagacccggcgctacctccccgcgatcgtccgggaggccatcaagcgcaagctgcgcaccctgatcctcgcccccacgcgggtggtggcctccgagatggcggaggccctgaaggggatgcccatccgctaccagaccaccgccgtcaagagcgagcacaccggccgggagatcgtggacctgatgtgccacgccacgttcaccatgcgcctcctgtccccggtgcgggtccccaactacaacatgatcatcatggacgaggcccacttcaccgaccccgcgagcatcgccgcccgcgggtacatctccacccgggtgggcatgggggaggccgccgcgatcttcatgacggccacgccgcccggcagcgtggaggccttcccccagtccaacgccgtcatccaggacgaggagcgcgacatccccgagcggagctggaactccggctacgactggatcaccgacttccccgggaagaccgtgtggttcgtgcccagcatcaagtccggcaacgacatcgccaactgcctgcgcaagaacgggaagcgggtcatccagctcagccgcaagacgttcgacaccgagtaccagaagaccaagaacaacgactgggactacgtggtgaccacggacatctccgagatgggcgcgaacttccgggccgaccgcgtcatcgacccccggcgctgcctgaagcccgtgatcctgaaggacgggcccgagcgggtcatcctcgccggcccgatgcccgtgaccgtggccagcgcggcccagcgccggggccgcatcgggcgcaaccagaacaaggagggcgaccagtacgtctacatggggcagcccctgaacaacgacgaggaccacgcccactggaccgaggccaagatgctgctcgacaacatcaacacccccgagggcatcatcccggccctgttcgagcccgagcgggagaagtccgcggccatcgacggggagtaccgcctgcggggcgaggcccgcaagacgttcgtggagctcatgcggcgcggcgacctgcccgtgtggctgagctacaaggtcgcctccgaggggttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgacccgctcgcgctgcgcgagttcaaggagttcgccgccggccggcgcagcgtcagcggcgacctgatcctcgagatcgggaagctgccccagcacctgaccctccgggcccagaacgccctggacaacctggtgatgctccacaactccgagcagggcgggaaggcgtaccgccacgccatggaggagctgcccgacaccatcgagacgctgatgctcctggccctgatcgccgtgctcaccggcggggtcaccctgttcttcctgagcggcaagggcctcgggaagacctccatcggcctgctgtgcgtgacggcgagctccgccctcctgtggatggccagcgtggagccccactggatcgccgcctccatcatcctggagttcttcctcatggtcctgctgatcccggagcccgaccggcagcgcacgccccaggacaaccagctcgcgtacgtggtgatcgggctgctgttcatgatcctcaccgtcgccgccaacgagatgggcctgctggagaccacgaagaaggacctcgggatcggctacgtggccgccgagaaccaccagcacgcgaccatgctggacgtggacctgcacccggccagcgcctggaccctctacgccgtcgccaccacggtgatcacccccatgatgcggcacaccatcgagaacaccacggcgaacatctccctgaccgccatcgccaaccaggccgccatcctgatgggcctcgacaaggggtggcccatcagcaagatggacatcggcgtgcccctgctggcgctcgggtgctactcccaggtcaacccgctgaccctgaccgccgccgtgctcatgctggtggcccactacgcgatcatcggccccgggctgcaggccaaggccacgcgcgaggcccagaagcgcaccgccgcgggcatcatgaagaaccccaccgtcgacggcatcgtggccatcgacctcgaccccgtggtctacgacgccaagttcgagaagcagctggggcagatcatgctgctcatcctgtgcaccagccagatcctgctcatgcggacgacctgggccctgtgcgagtccatcaccctggccaccggcccgctcacgaccctgtgggaggggagccccggcaagttctggaacaccaccatcgcggtgtccatggccaacatcttccgcggcagctacctggccggggccggcctcgccttctccctgatgaagtccctcgggggcgggcggcgcgggacgggcgcgcagggggagaccctcggcgagaagtggaagcggcagctgaaccagctgtccaagagcgagttcaacacctacaagcgcagcgggatcatggaggtggaccggtccgaggccaaggagggcctcaagcgcggggagaccacgaagcacgccgtcagccggggcaccgccaagctgcgctggttcgtggagcggaacctggtgaagcccgagggcaaggtcatcgacctggggtgcggccgcgggggctggtcctactactgcgcggggctcaagaaggtgaccgaggtgaagggctacaccaagggcgggcccggccacgaggagccgatccccatggccacctacgggtggaacctggtcaagctgcacagcggcaaggacgtgttcttcatgccgcccgagaagtgcgacacgctcctgtgcgacatcggggagtccagcccgaaccccaccatcgaggagggccggaccctgcgcgtgctcaagatggtcgagccctggctgcggggcaaccagttctgcatcaagatcctgaacccctacatgccgtccgtggtggagaccctcgagcagatgcagcgcaagcacgggggcatgctggtccggaaccccctgagccgcaactccacgcacgagatgtactgggtgagctgcgggaccggcaacatcgtgtccgccgtcaacatgaccagccggatgctcctgaaccgcttcaccatggcccaccgcaagcccacgtacgagcgggacgtggacctgggcgccgggacccgccacgtggcggtcgagcccgaggtggccaacctcgacatcatcggccagcggatcgagaacatcaagaacgagcacaagtccacctggcactacgacgaggacaacccgtacaagacctgggcctaccacgggagctacgaggtcaagccctccggcagcgcctccagcatggtgaacggggtggtccgcctgctgacgaagccctgggacgtgatccccatggtgacccagatcgccatgaccgacaccacgccgttcggccagcagcgggtcttcaaggagaaggtggacacccgcacgccccgggcgaagcgcggcaccacgcagatcatggaggtgaccgccaagtggctctgggggttcctgtcccggaacaagaagccccgcatctgcacccgggaggagttcacccgcaaggtccggagcaacgccgccatcggcgccgtgttcgtggacgagaaccagtggaacagcgcgaaggaggccgtcgaggacgagcgcttctgggacctggtgcaccgggagcgcgagctccacaagcaggggaagtgcgccacgtgcgtgtacaacatgatgggcaagcgggagaagaagctgggggagttcggcaaggccaagggctcccgcgcgatctggtacatgtggctgggggcccggttcctcgagttcgaggccctgggcttcatgaacgaggaccactggttcagccgcgagaactccctgagcggggtcgagggcgaggggctccacaagctgggctacatcctgcgggacatctccaagatcccgggcgggaacatgtacgccgacgacaccgccggctgggacacccgcatcaccgaggacgacctccagaacgaggcgaagatcacggacatcatggagcccgagcacgccctgctggccaccagcatcttcaagctcacctaccagaacaaggtggtgcgcgtccagcggcccgccaagaacgggaccgtgatggacgtgatctcccgccgggaccagcgcggcagcggccaggtcgggacgtacggcctgaacaccttcaccaacatggaggtgcagctgatccggcagatggagtccgaggggatcttcctccccagcgagctggagaccccgaacctggccgagcgcgcgctcgactggctggagaagcacggcgccgagcggctgaagcgcatggccatctccggggacgactgcgtggtcaagcccatcgacgaccggttcgccacggccctcaccgcgctgaacgacatgggcaaggtgcgcaaggacatcccccagtgggagcccagcaagggctggaacgactggcagcaggtcccgttctgctcccaccacttccaccagctgatcatgaaggacgggcgggagatcgtcgtgccctgccgcaaccaggacgagctcgtgggccgggcccgcgtcagccagggggccggctggtccctgcgggagaccgcctgcctgggcaagagctacgcccagatgtggcagctcatgtacttccaccgccgggacctgcgcctggcggccaacgccatctgctccgccgtgcccgtggactgggtccccaccagccggaccacgtggagcatccacgcgcaccaccagtggatgaccaccgaggacatgctctccgtgtggaaccgcgtgtggatcgaggagaacccgtggatggaggacaagacccacgtcagctcctgggaggaggtgccctacctgggcaagcgcgaggaccagtggtgcggcagcctgatcgggctcacggcccgggccacctgggccaccaacatccaggtggccatcaaccaggtccgccggctgatcggcaacgagaactacctggactacatgacctccatgaagcgcttcaagaacgagagcgaccccgagggggcgctctggtga

SEQ ID NO: 8232 - RNA, 9879 nt, synthetic construct
  misc_feature 1..9879: note = derived and/or modified CDS sequence (opt1) from DENV-1__EU482611__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagctcaccgtcgtggtgggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctctggtccaacggggtgctggagagcgagatgatcatccccaagatctacggcgggccgatctcccagcacaactaccggcccggctacttcacccagaccgccgggccctggcacctgggcaagctcgagctggacttcgacctgtgcgagggcacgaccgtggtcgtggacgagcactgcgggaaccgcggcccgagcctccggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctcgtgcgcagcatggtgtccgccggcagcggggaggtcgacagcttctccctgggcatcctgtgcgtgagcatcatgatcgaggaggtgatgcggtcccgctggagccgcaagatgctcatgaccgggacgctggccgtcttcctgctcctgatcatgggccagctgacctggaacgacctcatccggctgtgcatcatggtgggggccaacgcgtccgaccgcatgggcatgggcaccacctacctggccctcatggccacgttcaagatgcggccgatgttcgccgtggggctgctgttccgccggctcaccagccgcgaggtcctgctgctcaccatcggcctgtccctggtggccagcgtcgagctccccaactccctggaggagctgggggacggcctcgcgatgggcatcatgatgctgaagctgctcaccgagttccagccccaccagctgtggacgaccctgctcagcctgaccttcgtgaagaccacgctgtccctcgactacgcctggaagaccaccgccatggtgctgagcatcgtctccctgttccccctctgcctgagcaccacgtcccagaagaccacctggctgccggtgctcctggggagcttcggctgcaagcccctgaccatgttcctcatcaccgagaacaagatctgggggcggaagtcctggcccctgaacgagggcatcatggccatcgggatcgtgagcatcctgctctccagcctgctgaagaacgacgtccccctcgcgggcccgctgatcgccggcgggatgctgatcgcctgctacgtgatcagcggctccagcgccgacctctccctggagaaggccgcggaggtgagctgggagcaggaggccgagcactccggggccagccacaacatcctggtcgaggtgcaggacgacggcacgatgaagatcaaggacgaggagcgcgacgacaccctcaccatcctgctgaaggccaccctcctggccgtgtccggggtctaccccatgagcatccccgcgacgctgttcgtgtggtacttctggcagaagaagaagcagcggtccggcgtgctctgggacacccccagcccgcccgaggtcgagcgcgccgtgctggacgacggcatctaccggatcctgcagcgcgggctgctcggccggtcccaggtgggggtcggcgtgttccaggacggggtgttccacaccatgtggcacgtcacccgcggcgccgtgctgatgtaccagggcaagcggctggagcccagctgggcctccgtgaagaaggacctcatcagctacgggggcgggtggcgcttccagggctcctggaacacgggggaggaggtccaggtgatcgccgtggagcccggcaagaacccgaagaacgtccagaccacccccggcaccttcaagacgcccgagggggaggtgggcgcgatcgccctggacttcaagcccgggaccagcggctccccgatcgtgaaccgggagggcaagatcgtcgggctgtacggcaacggggtggtgaccaccagcggcacgtacgtctccgccatcgcccaggccaaggcgagccaggaggggcccctccccgagatcgaggacgaggtgttcaagaagcgcaacctgaccatcatggacctgcacccgggcagcggcaagacccggcgctacctccccgccatcgtgcgggaggccatcaagcgcaagctgcgcaccctgatcctcgcccccacgcgggtcgtggcgtccgagatggccgaggccctgaaggggatgcccatccgctaccagaccaccgccgtcaagagcgagcacaccggccgggagatcgtcgacctgatgtgccacgccacgttcaccatgcgcctcctgtccccggtgcgggtgcccaactacaacatgatcatcatggacgaggcgcacttcaccgaccccgccagcatcgccgcccgcgggtacatctccacccgggtcggcatgggggaggccgcggccatcttcatgacggccacgccgcccggcagcgtggaggccttcccccagtccaacgccgtgatccaggacgaggagcgcgacatccccgagcggagctggaactccggctacgactggatcaccgacttccccgggaagaccgtctggttcgtgcccagcatcaagtccggcaacgacatcgcgaactgcctgcgcaagaacgggaagcgggtgatccagctcagccgcaagacgttcgacaccgagtaccagaagaccaagaacaacgactgggactacgtcgtgaccacggacatctccgagatgggcgccaacttccgggccgaccgcgtgatcgacccccggcgctgcctgaagcccgtcatcctgaaggacgggcccgagcgggtgatcctcgccggcccgatgcccgtcaccgtggcgagcgccgcccagcgccggggccgcatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgggagaagtccgccgccatcgacggggagtaccgcctgcggggcgaggcccgcaagacgttcgtcgagctcatgcggcgcggcgacctgcccgtgtggctgagctacaaggtggcctccgaggggttccagtacagcgaccggcgctggtgcttcgacggcgagcggaacaaccaggtcctcgaggagaacatggacgtggagatctggaccaaggagggggagcgcaagaagctgcggccccgctggctggacgcgcggacctactccgacccgctcgccctgcgcgagttcaaggagttcgccgccggccggcgcagcgtgagcggcgacctgatcctcgagatcgggaagctgccccagcacctgaccctccgggcccagaacgcgctggacaacctggtcatgctccacaactccgagcagggcgggaaggcctaccgccacgccatggaggagctgcccgacaccatcgagacgctgatgctcctggccctgatcgcggtgctcaccggcggggtgaccctgttcttcctgagcggcaagggcctcgggaagacctccatcggcctgctgtgcgtcacggccagctccgccctcctgtggatggccagcgtggagccccactggatcgccgcgtccatcatcctggagttcttcctcatggtgctgctgatcccggagcccgaccggcagcgcacgccccaggacaaccagctcgcctacgtcgtgatcgggctgctgttcatgatcctcaccgtggccgccaacgagatgggcctgctggagaccacgaagaaggacctcgggatcggctacgtcgccgcggagaaccaccagcacgccaccatgctggacgtggacctgcacccggccagcgcctggaccctctacgccgtggcgaccacggtcatcacccccatgatgcggcacaccatcgagaacaccacggccaacatctccctgaccgccatcgccaaccaggccgcgatcctgatgggcctcgacaaggggtggcccatcagcaagatggacatcggcgtgcccctgctggccctcgggtgctactcccaggtgaacccgctgaccctgaccgccgccgtcctcatgctggtggcgcactacgccatcatcggccccgggctgcaggccaaggccacgcgcgaggcccagaagcgcaccgcggccggcatcatgaagaaccccaccgtggacggcatcgtcgccatcgacctcgaccccgtggtgtacgacgccaagttcgagaagcagctggggcagatcatgctgctcatcctgtgcaccagccagatcctgctcatgcggacgacctgggccctgtgcgagtccatcaccctggcgaccggcccgctcacgaccctgtgggaggggagccccggcaagttctggaacaccaccatcgccgtctccatggccaacatcttccgcggcagctacctggccggggccggcctcgcgttctccctgatgaagtccctcgggggcgggcggcgcgggacgggcgcccagggggagaccctcggcgagaagtggaagcggcagctgaaccagctgtccaagagcgagttcaacacctacaagcgcagcgggatcatggaggtggaccggtccgaggccaaggagggcctcaagcgcggggagaccacgaagcacgccgtgagccggggcaccgcgaagctgcgctggttcgtcgagcggaacctggtgaagcccgagggcaaggtgatcgacctggggtgcggccgcgggggctggtcctactactgcgccgggctcaagaaggtcaccgaggtgaagggctacaccaagggcgggcccggccacgaggagccgatccccatggccacctacgggtggaacctggtgaagctgcacagcggcaaggacgtcttcttcatgccgcccgagaagtgcgacacgctcctgtgcgacatcggggagtccagcccgaaccccaccatcgaggagggccggaccctgcgcgtgctcaagatggtggagccctggctgcggggcaaccagttctgcatcaagatcctgaacccctacatgccgtccgtcgtggagaccctcgagcagatgcagcgcaagcacgggggcatgctggtgcggaaccccctgagccgcaactccacgcacgagatgtactgggtcagctgcgggaccggcaacatcgtgtccgccgtgaacatgaccagccggatgctcctgaaccgcttcaccatggcccaccgcaagcccacgtacgagcgggacgtcgacctgggcgcggggacccgccacgtggccgtggagcccgaggtcgccaacctcgacatcatcggccagcggatcgagaacatcaagaacgagcacaagtccacctggcactacgacgaggacaacccgtacaagacctgggcctaccacgggagctacgaggtgaagccctccggcagcgcctccagcatggtcaacggggtggtgcgcctgctgacgaagccctgggacgtcatccccatggtgacccagatcgcgatgaccgacaccacgccgttcggccagcagcgggtgttcaaggagaaggtcgacacccgcacgccccgggccaagcgcggcaccacgcagatcatggaggtgaccgccaagtggctctgggggttcctgtcccggaacaagaagccccgcatctgcacccgggaggagttcacccgcaaggtgcggagcaacgccgccatcggcgcggtcttcgtggacgagaaccagtggaacagcgccaaggaggccgtggaggacgagcgcttctgggacctggtccaccgggagcgcgagctccacaagcaggggaagtgcgccacgtgcgtgtacaacatgatgggcaagcgggagaagaagctgggggagttcggcaaggcgaagggctcccgcgccatctggtacatgtggctgggggcccggttcctcgagttcgaggccctgggcttcatgaacgaggaccactggttcagccgcgagaactccctgagcggggtggagggcgaggggctccacaagctgggctacatcctgcgggacatctccaagatcccgggcgggaacatgtacgccgacgacaccgcgggctgggacacccgcatcaccgaggacgacctccagaacgaggccaagatcacggacatcatggagcccgagcacgccctgctggccaccagcatcttcaagctcacctaccagaacaaggtcgtgcgcgtgcagcggcccgccaagaacgggaccgtcatggacgtgatctcccgccgggaccagcgcggcagcggccaggtggggacgtacggcctgaacaccttcaccaacatggaggtccagctgatccggcagatggagtccgaggggatcttcctccccagcgagctggagaccccgaacctggcggagcgcgccctcgactggctggagaagcacggcgccgagcggctgaagcgcatggccatctccggggacgactgcgtggtgaagcccatcgacgaccggttcgccacggcgctcaccgccctgaacgacatgggcaaggtccgcaaggacatcccccagtgggagcccagcaagggctggaacgactggcagcaggtcccgttctgctcccaccacttccaccagctgatcatgaaggacgggcgggagatcgtggtcccctgccgcaaccaggacgagctcgtgggccgggcccgcgtgagccagggggccggctggtccctgcgggagaccgcctgcctgggcaagagctacgcgcagatgtggcagctcatgtacttccaccgccgggacctgcgcctggccgccaacgccatctgctccgcggtccccgtggactgggtgcccaccagccggaccacgtggagcatccacgcccaccaccagtggatgaccaccgaggacatgctctccgtctggaaccgcgtgtggatcgaggagaacccgtggatggaggacaagacccacgtgagctcctgggaggaggtcccctacctgggcaagcgcgaggaccagtggtgcggcagcctgatcgggctcacggcccgggccacctgggccaccaacatccaggtggcgatcaaccaggtgcgccggctgatcggcaacgagaactacctggactacatgacctccatgaagcgcttcaagaacgagagcgaccccgagggggccctctggtga

SEQ ID NO: 8233 - RNA, 9879 nt, synthetic construct
  misc_feature 1..9879: note = derived and/or modified CDS sequence (opt1) from DENV-1__FJ639735__SS-prME
  source 1..9879: mol_type = other RNA
agcgtgaccatgctgctcatgctgctgcccaccgccctcgccttccacctgacgacccggggcggggagccccacatgatcgtgagcaagcaggagcggggcaagagcctcctgttcaagaccagcgccggggtgaacatgtgcaccctgatcgccatggacctgggcgagctctgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgaccgccctgttcctcgcgcacgccatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgcggtgctccggaagctgtgcatcgaggccaagatcagcaacaccacgaccgactcccgctgccccacccagggcgaggccaccctggtggaggagcaggacgccaacttcgtctgccggcgcacgttcgtggaccggggctgggggaacggctgcggcctcttcggcaaggggagcctgctgacctgcgccaagttcaagtgcgtgaccaagctcgagggcaagatcgtccagtacgagaacctgaagtactccgtgatcgtgaccgtccacacgggcgaccagcaccaggtggggaacgagaccaccgagcacggcaccatcgcgaccatcacgccccaggcccccaccagcgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggacctccggggccagcaccagccaggagacgtggaaccggcaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcacctcctacgtcatgtgcacggggagcttcaagctggagaaggaggtggcggagacccagcacggcaccgtgctggtccaggtgaagtacgagggcaccgacgccccctgcaagatccccttctccacgcaggacgagaagggggtgacccagaacggccggctcatcaccgccaacccgatcgtcaccgacaaggagaagcccgtgaacatcgagacggagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacaccgcgtgggacttcgggagcatcggcggcgtgttcacctccgtggggaagctggtccaccaggtgttcggcacggcctacggggtgctgttcagcggcgtctcctggaccatgaagatcgggatcggcatcctcctgacctggctgggcctcaacagccgctccaccagcctgtccatgacgtgcatcgccgtggggatggtgaccctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacgcgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacacgccggagtgccccgacgaccagcgcgcctggaacatctgggaggtcgaggactacggcttcgggatcttcaccaccaacatctggctgaagctccgggactcctacacccagatgtgcgaccaccgcctgatgagcgcggccatcaaggactccaaggccgtgcacgccgacatgggctactggatcgagagcgagaagaacgagacgtggaagctggcccgggcgtccttcatcgaggtgaagacctgcacctggcccaagagccacaccctctggtccaacggcgtcctggagagcgagatgatcatccccaagatctacgggggcccgatctcccagcacaactaccgccccgggtacttcacgcagaccgccggcccctggcacctggggaagctcgagctggacttcaacctgtgcgagggcaccaccgtggtggtcgacgagcactgcggcaaccgggggccgagcctccgcacgaccaccgtgaccggcaagatcatccacgagtggtgctgccggtcctgcacgctgccgcccctgcgcttccgcggggaggacggctgctggtacgggatggagatccgccccgtgaaggagaaggaggagaacctcgtccggagcatggtgtccgccggcagcggcgaggtggacagcttctccctggggatcctgtgcgtcagcatcatgatcgaggaggtgatgcgctcccggtggagccgcaagatgctcatgaccggcaccctggccgtgttcctgctcctgatcatggggcagctgacctggaacgacctcatccgcctgtgcatcatggtcggcgccaacgcgtccgaccggatggggatgggcacgacctacctggccctcatggccaccttcaagatgcgcccgatgttcgccgtgggcctgctgttccggcgcctcaccagccgggaggtgctgctgctcacgatcgggctgtccctggtcgccagcgtggagctccccaactccctggaggagctgggcgacgggctcgcgatgggcatcatgatgctgaagctgctcaccgagttccagccccaccagctgtggaccaccctgctcagcctgacgttcatcaagaccaccctgtccctcgactacgcctggaagaccacggccatggccctgagcatcgtctccctgttccccctctgcctgagcaccacctcccagaagaccacctggctgccggtgctcctgggcagcttcgggtgcaagcccctgacgatgttcctcatcaccgagaacaagatctggggccgcaagtcctggcccctgaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgaagatcaaggacgaggagaaggacgacacgctcaccatcctgctgaaggccaccctcctggccgtgtccggcgtctaccccatgagcatccccgcgaccctgttcgtgtggtacttctggcagaagaagaagcagcggtccggggtgctctgggacacgcccagcccgcccgaggtcgagcgcgccgtgctggacgacggcatctaccggatcctgcagcgcggcctgctcgggcggtcccaggtgggcgtcggggtgttccaggacggcgtgttccacaccatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagacgacccccggcaccttcaagacccccgagggcgaggtgggggcgatcgccctggacttcaagcccggcacgagcgggtccccgatcgtgaaccgggagggcaagatcgtcggcctgtacgggaacggcgtggtgaccaccagcgggacctacgtctccgccatcgcccaggccaaggcgagccaggagggccccctccccgagatcgaggacgaggtgttcaagaagcgcaacctgacgatcatggacctgcacccggggagcggcaagacccggcgctacctccccgccatcgtgcgggaggccatcaagcgcaagctgcggaccctgatcctcgcccccacccgcgtcgtggcgtccgagatggccgaggccctgaagggcatgcccatccgctaccagacgaccgccgtcaagagcgagcacaccgggcgggagatcgtcgacctgatgtgccacgccaccttcacgatgcgcctcctgtccccggtgcgggtgcccaactacaacatgatcgtcatggacgaggcgcacttcaccgaccccgccagcatcgccgcccgcggctacatctccacccgggtggggatgggcgaggccgcggccatcttcatgaccgccacgcccccggggagcgtggaggccttcccccagtccaacgccgtcatccaggacgaggagcgcgacatccccgagcggagctggaactccggctacgactggatcaccgacttccccggcaagaccgtgtggttcgtgccgagcatcaagtccgggaacgacatcgcgaactgcctgcgcaagaacggcaagcgggtcatccagctcagccgcaagaccttcgacacggagtaccagaagaccaagaacaacgactgggactacgtggtgaccaccgacatctccgagatgggggccaacttccgggccgaccgcgtcatcgacccccggcgctgcctgaagcccgtgatcctgaaggacggccccgagcgggtgatcctcgccgggccgatgcccgtcacggtggcgagcgccgcccagcgccggggccgcatcggccggaaccagaacaaggagggggaccagtacgtctacatgggccagcccctgaacaacgacgaggaccacgcccactggaccgaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtggagctcatgcggcgcggcgacctgcccgtgtggctgagctacaaggtcgcctccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcgcggacgtactccgacccgctcgccctgcgcgagttcaaggagttcgccgccgggcggcgcagcgtcagcggcgacctgatcctcgagatcggcaagctgccccagcacctgaccctccgggcccagaacgcgctggacaacctggtgatgctccacaactccgagcagggcgggaaggcctaccgccacgccatggaggagctgcccgacaccatcgagaccctgatgctcctggccctgatcgcggtgctcaccggcggggtcaccctgttcttcctgagcgggaaggggctcggcaagacctccatcgggctgctgtgcgtgaccgccagctccgccctcctgtggatggccagcgtggagccccactggatcgccgcgtccatcatcctggagttcttcctcatggtcctgctgatcccggagcccgaccggcagcgcacgccccaggacaaccagctcgcctacgtggtgatcggcctgctgttcatgatcctcaccgtcgccgccaacgagatggggctgctggagaccaccaagcgggacctcggcatcgggcacgtggccgcggagaaccaccagcacgccacgatgctggacgtggacctgcgcccggccagcgcctggaccctctacgccgtcgcgaccaccgtgatcacgcccatgatgcggcacaccatcgagaacaccaccgccaacatctccctgacggccatcgccaaccaggccgcgatcctgatgggcctcgacaagggctggcccatcagcaagatggacatcggggtgcccctgctggccctcggctgctactcccaggtcaacccgctgaccctgaccgccgccgtgctcatgctggtggcgcactacgccatcatcgggcccggcctgcaggccaaggccacccgcgaggcccagaagcgcacggcggccgggatcatgaagaaccccaccgtcgacggcatcgtggccatcgacctcgaccccgtggtctacgacgccaagttcgagaagcagctgggccagatcatgctgctcatcctgtgcaccagccagatcctgctcatgcggaccacgtgggccctgtgcgagtccatcaccctggcgaccgggccgctcaccacgctgtgggagggcagccccgggaagttctggaacaccaccatcgccgtgtccatggccaacatcttccgcggcagctacctggccggcgccgggctcgcgttctccctgatgaagtccctgggcgggggccggcgcgggaccggcgcccagggcgagacgctcggggagaagtggaagcggcagctgaaccagctgtccaagagcgagttcaacacctacaagcgcagcggcatcatggaggtggaccggtccgaggccaaggaggggctcaagcgcggcgagaccaccaagcacgccgtcagccgggggaccgcgaagctgcgctggttcgtggagcggaacctggtgaagcccgagggcaaggtcatcgacctgggctgcgggcgcggcgggtggtcctactactgcgccggcctcaagaaggtgacggaggtgaaggggtacaccaagggcggccccgggcacgaggagccgatccccatggccacctacggctggaacctggtcaagctgcacagcgggaaggacgtgttcttcatgccgcccgagaagtgcgacaccctcctgtgcgacatcggcgagtccagcccgaaccccacgatcgaggaggggcggaccctgcgcgtgctcaagatggtcgagccctggctgcggggcaaccagttctgcatcaagatcctgaacccctacatgccgtccgtggtggagaccctcgagcagatgcagcgcaagcacggcgggatgctggtccggaaccccctgagccgcaactccacccacgagatgtactgggtgagctgcggcacggggaacatcgtgtccgccgtcaacatgaccagccggatgctcctgaaccgcttcaccatggcccaccgcaagcccacctacgagcgggacgtggacctgggcgcgggcacgcgccacgtggccgtcgagcccgaggtggccaacctcgacatcatcgggcagcggatcgagaacatcaagaacgagcacaagtccacctggcactacgacgaggacaacccgtacaagacctgggcctaccacggcagctacgaggtgaagccctccgggagcgcctccagcatggtcaacggcgtggtccgcctgctgaccaagccctgggacgtgatccccatggtgacgcagatcgcgatgaccgacaccaccccgttcgggcagcagcgggtcttcaaggagaaggtggacacgcgcacgccccgggccaagcgcggcaccacccagatcatggaggtgacggccaagtggctctggggcttcctgtcccggaacaagaagccccgcatctgcacccgggaggagttcacccgcaaggtccggagcaacgccgccatcggggcggtgttcgtggacgagaaccagtggaacagcgccaaggaggccgtcgaggacgagcgcttctgggacctggtgcaccgggagcgcgagctccacaagcagggcaagtgcgcgacctgcgtgtacaacatgatggggaagcgggagaagaagctgggcgagttcgggaaggcgaagggctcccgcgccatctggtacatgtggctgggcgcccggttcctcgagttcgaggccctggggttcatgaacgaggaccactggttcagccgcgagaactccctgagcggcgtcgagggggagggcctccacaagctggggtacatcctgcgggacatctccaagatcccgggcggcaacatgtacgccgacgacacggcggggtgggacacccgcatcaccgaggacgacctccagaacgaggccaagatcaccgacatcatggagcccgagcacgccctgctggccacgagcatcttcaagctcacctaccagaacaaggtggtgcgcgtccagcggcccgccaagaacggcaccgtgatggacgtgatctcccgccgggaccagcgcgggagcggccaggtcggcacctacgggctgaacacgttcaccaacatggaggtgcagctgatccggcagatggagtccgagggcatcttcctccccagcgagctggagaccccgaacctggcggagcgcgtgctcgactggctggagaagcacggggccgagcggctgaagcgcatggccatctccggcgacgactgcgtcgtgaagcccatcgacgaccggttcgccaccgccctcaccgcgctgaacgacatggggaaggtgcgcaaggacatcccccagtgggagcccagcaagggctggaacgactggcagcaggtcccgttctgctcccaccacttccaccagctgatcatgaaggacggccgggagatcgtggtgccctgccgcaaccaggacgagctcgtcgggcgggcccgcgtgagccagggcgccgggtggtccctgcgggagacggcctgcctgggcaagagctacgcccagatgtggcagctcatgtacttccaccgccgggacctgcgcctggcggccaacgccatctgctccgccgtgcccgtcgactgggtgcccaccagccggaccacctggagcatccacgcgcaccaccagtggatgacgaccgaggacatgctctccgtgtggaaccgcgtctggatcgaggagaacccgtggatggaggacaagacccacgtgagctcctgggaggaggtgccctacctggggaagcgcgaggaccagtggtgcggcagcctgatcggcctcaccgcccgggccacgtgggccaccaacatccaggtcgccatcaaccaggtgcgccggctgatcgggaacgagaactacctggactacatgacctccatgaagcgcttcaagaacgagagcgaccccgagggcgcgctctggtga

SEQ ID NO: 8234 - RNA, 9879 nt, synthetic construct
  misc_feature 1..9879: note = derived and/or modified CDS sequence (opt1) from DENV-1__FJ639740__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccctcgtggaccggggctgggggaacggctgcgggctgttcggcaaggggagcctgctcacgtgcgccaagttcaagtgcgtgaccaagctggagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctcaccgactacggggccctgaccctggactgcagcccccgcaccggcctcgacttcaacgagatggtcctgctgacgatgaaggagaagtcctggctcgtgcacaagcagtggttcctggacctgccgctcccctggacctccggggccagcaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcatgtcctacgtcatgtgcaccgggagcttcaagctggagaaggaggtggcggagacccagcacggcacggtgctcgtccaggtgaagtacgagggcaccgacgccccctgcaagatccccttcgccacccaggacgagaagggggtgacccagaacggccggctgatcacggccaacccgatcgtcaccgacaaggagaagcccgtgaacatcgagaccgagccgcccttcggggagtcctacatcgtggtcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccaggtgttcggcaccgcctacggggtcctgttctccggcgtcagctggaccatgaagatcgggatcggcatcctgctgacgtggctcggcctgaactcccgcagcacctccctgagcatgacctgcatcgccgtggggatggtgaccctctacctgggcgtcatggtgcaggccgactccgggtgcgtgatcaactggaagggccgggagctgaagtgcgggagcggcatcttcgtcacgaacgaggtgcacacctggaccgagcagtacaagttccaggcggactccccgaagcgcctcagcgccgccatcggcaaggcctgggaggagggggtgtgcggcatccggagcgccacccgcctggagaacatcatgtggaagcagatctccaacgagctgaaccacatcctcctggagaacgacatgaagttcaccgtcgtggtgggggacgcgaacggcatcctggcccaggggaagaagatgatccggccccagcccatggagcacaagtacagctggaagtcctggggcaaggccaagatcatcggcgccgacatccagaacacgaccttcatcatcgacgggcccgacaccccggagtgccccgacggccagcgcgcgtggaacatctgggaggtcgaggactacgggttcggcatcttcaccacgaacatctggctcaagctgcgggacagctacacccagatgtgcgaccaccgcctgatgtccgccgccatcaaggacagcaaggccgtgcacgccgacatgggctactggatcgagtccgagaagaacgagacctggaagctcgcgcgggccagcttcatcgaggtgaagacctgcacgtggcccaagtcccacaccctgtggagcaacggggtcctggagtccgagatgatcatccccaagatctacggcgggccgatcagccagcacaactaccgccccggctacttcacccagaccgccgggccctggcacctcggcaagctggagctggacttcgacctctgcgagggcacgaccgtggtggtcgacgagcactgcgggaaccggggcccgtccctgcgcaccaccacggtgaccgggaagatcatccacgagtggtgctgccggagctgcaccctgccgcccctgcgcttccggggcgaggacgggtgctggtacggcatggagatccgccccgtgaaggagaaggaggagaacctggtccggtccatggtgagcgccggctccggggaggtggacagcttcagcctgggcatcctctgcgtctccatcatgatcgaggaggtgatgcgcagccggtggtcccgcaagatgctgatgaccgggacgctggccgtgttcctcctgctgatcatgggccagctcacctggaacgacctgatccgcctgtgcatcatggtcggggcgaacgccagcgaccggatgggcatgggcaccacctacctcgccctgatggccacgttcaagatgcgcccgatgttcgccgtggggctcctcttccggcgcctgacctcccgggaggtgctgctcctgaccatcggcctgagcctcgtcgcgtccgtggagctgcccaacagcctggaggagctcggggacggcctggccatgggcatcatgatgctgaagctcctgaccgagttccagccccaccagctgtggacgaccctcctgtccctgaccttcgtcaagaccacgctcagcctggactacgcctggaagaccaccgccatggtgctgtccatcgtgagcctcttccccctgtgcctgtccaccacgagccagaagaccacctggctcccggtcctgctggggtccttcggctgcaagcccctcaccatgttcctgatcaccgagaacaagatctgggggcgcaagagctggcccctgaacgagggcatcatggcgatcgggatcgtgtccatcctcctgagctccctgctcaagaacgacgtgcccctggccggcccgctgatcgccggcgggatgctcatcgcctgctacgtcatcagcggcagctccgccgacctgagcctggagaaggcggccgaggtgtcctgggagcaggaggccgagcacagcggggcctcccacaacatcctcgtggaggtccaggacgacggcacgatgaagatcaaggacgaggagcgggacgacaccctgaccatcctgctcaaggccaccctgctggcggtgagcggggtgtaccccatgtccatccccgccaccctcttcgtctggtacttctggcagaagaagaagcagcgcagcggcgtgctgtgggacaccccctccccgcccgaggtggagcgggccgtcctggacgacggcatctaccgcatcctgcagcgggggctcctgggccgcagccaggtgggggtgggcgtcttccaggacggggtgttccacaccatgtggcacgtgacccggggcgccgtcctgatgtaccagggcaagcgcctcgagccctcctgggccagcgtgaagaaggacctgatctcctacgggggcgggtggcggttccagggcagctggaacacgggggaggaggtgcaggtcatcgcggtggagcccggcaagaacccgaagaacgtgcagaccacccccggcaccttcaagacgcccgagggggaggtcggcgccatcgccctggacttcaagcccgggacctccggcagcccgatcgtgaaccgcgagggcaagatcgtggggctctacggcaacggggtcgtgaccacctccggcacgtacgtgagcgccatcgcccaggcgaaggcctcccaggaggggcccctgcccgagatcgaggacgaggtcttcaagaagcggaacctgaccatcatggacctccacccgggcagcggcaagacccgccggtacctgcccgccatcgtgcgcgaggccatcaagcggaagctgcgcaccctcatcctggcgcccacgcgcgtggtcgccagcgagatggccgaggccctgaaggggatgcccatccggtaccagaccaccgccgtgaagtccgagcacaccggccgcgagatcgtggacctcatgtgccacgcgacgttcaccatgcggctgctgagcccggtccgcgtgcccaactacaacatgatcatcatggacgaggcccacttcaccgaccccgcctccatcgccgcccgggggtacatcagcacccgcgtgggcatgggggaggcggccgccatcttcatgacggccacgccgcccggctccgtcgaggccttcccccagagcaacgcggtgatccaggacgaggagcgggacatccccgagcgctcctggaacagcggctacgactggatcaccgacttccccgggaagaccgtgtggttcgtcccctccatcaagagcggcaacgacatcgccaactgcctccggaagaacgggaagcgcgtgatccagctgtcccggaagacgttcgacaccgagtaccagaagaccaagaacaacgactgggactacgtggtcaccacggacatcagcgagatgggcgccaacttccgcgccgaccgggtgatcgacccccgccggtgcctgaagcccgtgatcctcaaggacgggcccgagcgcgtcatcctggcgggcccgatgcccgtgaccgtcgcctccgccgcccagcggcgcggccggatcgggcgcaaccagaacaaggagggcgaccagtacgtgtacatggggcagcccctgaacaacgacgaggaccacgcccactggaccgaggcgaagatgctcctggacaacatcaacacccccgagggcatcatcccggccctgttcgagcccgagcgcgagaagtccgccgccatcgacggggagtaccggctccgcggcgaggcccggaagacgttcgtggagctgatgcgccggggcgacctgcccgtctggctctcctacaaggtggcgagcgaggggttccagtactccgaccgccggtggtgcttcgacggcgagcgcaacaaccaggtgctggaggagaacatggacgtcgagatctggaccaaggagggggagcggaagaagctgcgcccccggtggctcgacgcccgcacctacagcgacccgctggccctgcgggagttcaaggagttcgccgccggccgccggtccgtgagcggcgacctcatcctggagatcgggaagctgccccagcacctcaccctgcgcgcgcagaacgccctggacaacctcgtgatgctgcacaacagcgagcagggcgggaaggcctaccggcacgccatggaggagctgcccgacaccatcgagacgctcatgctgctggcgctcatcgccgtcctgaccggcggggtgaccctgttcttcctctccggcaagggcctggggaagaccagcatcggcctgctctgcgtgacggcctccagcgccctgctgtggatggcctccgtcgagccccactggatcgcggccagcatcatcctcgagttcttcctgatggtgctgctcatcccggagcccgaccgccagcggacgccccaggacaaccagctggcctacgtggtcatcgggctcctcttcatgatcctgaccgtggccgccaacgagatgggcctgctcgagaccacgaagaaggacctggggatcggctacgtggcggccgagaaccaccagcacgccaccatgctggacgtcgacctccgcccggcctccgcctggaccctgtacgcggtggccaccacggtgatcacccccatgatgcggcacaccatcgagaacaccacggccaacatcagcctgaccgccatcgccaaccaggcggccatcctcatgggcctggacaaggggtggcccatctccaagatggacatcggcgtccccctgctcgccctggggtgctacagccaggtgaacccgctgaccctcaccgccgcggtgctgatgctggtcgcccactacgccatcatcggccccgggctccaggccaaggccacgcgcgaggcgcagaagcgcaccgccgccggcatcatgaagaaccccaccgtggacggcatcgtggccatcgacctggaccccgtcgtgtacgacgccaagttcgagaagcagctggggcagatcatgctcctgatcctgtgcacctcccagatcctcctgatgcggacgacctgggcgctgtgcgagagcatcaccctcgccaccggcccgctgacgaccctgtgggaggggtcccccggcaagttctggaacaccaccatcgccgtgagcatggccaacatcttccgcggctcctacctcgccggggcgggcctggccttcagcctgatgaagtccctcgggggcgggcggcgcggcacgggcgcccagggggagaccctgggcgagaagtggaagcggcagctgaaccagctcagcaagtccgagttcaacacctacaagcgcagcgggatcatggaggtcgaccggagcgaggccaaggagggcctgaagcgcggggagaccacgaagcacgcggtgtcccggggcaccgccaagctgcgctggttcgtggagcggaacctggtcaagcccgagggcaaggtgatcgacctcgggtgcggccgcgggggctggagctactactgcgccgggctgaagaaggtgaccgaggtcaagggctacaccaagggcgggcccggccacgaggagccgatccccatggccacctacgggtggaacctggtgaagctccactccggcaaggacgtgttcttcatgccgcccgagaagtgcgacacgctgctgtgcgacatcggggagagctccccgaaccccaccatcgaggagggccggaccctccgcgtcctgaagatggtggagccctggctgcggggcaaccagttctgcatcaagatcctcaacccctacatgccgagcgtggtcgagaccctggagcagatgcagcgcaagcacgggggcatgctggtgcggaaccccctctcccgcaacagcacgcacgagatgtactgggtgtcctgcgggaccggcaacatcgtcagcgccgtgaacatgacctcccggatgctgctgaaccgcttcaccatggcgcaccgcaagcccacgtacgagcgggacgtggacctcggcgccgggacccgccacgtcgccgtggagcccgaggaggccaacctggacatcatcggccagcggatcgagaacatcaagaacgagcacaagagcacctggcactacgacgaggacaacccgtacaagacctgggcctaccacgggtcctacgaggtgaagcccagcggctccgcgagctccatggtcaacggggtggtccgcctgctcacgaagccctgggacgtgatccccatggtgacccagatcgccatgaccgacaccacgccgttcggccagcagcgggtcttcaaggagaaggtggacacccgcacgccccgggccaagcgcggcaccacgcagatcatggaggtgaccgccaagtggctgtgggggttcctgagccggaacaagaagccccgcatctgcacccgggaggagttcacccgcaaggtccggtccaacgccgcgatcggcgccgtgttcgtggacgagaaccagtggaacagcgccaaggaggccgtcgaggacgagcgcttctgggacctcgtgcaccgggagcgcgagctgcacaagcaggggaagtgcgcgacgtgcgtgtacaacatgatgggcaagcgggagaagaagctgggggagttcggcaaggccaagggcagccgcgccatctggtacatgtggctcggggcccggttcctggagttcgaggccctgggcttcatgaacgaggaccactggttctcccgcgagaacagcctctccggggtcgagggcgaggggctgcacaagctgggctacatcctccgggacatcagcaagatcccgggcgggaacatgtacgcggacgacaccgccggctgggacacccgcatcaccgaggacgacctgcagaacgaggccaagatcacggacatcatggagcccgagcacgccctgctcgccacctccatcttcaagctgacctaccagaacaaggtggtgcgcgtccagcggcccgcgaagaacgggaccgtgatggacgtgatcagccgccgggaccagcgcggctccggccaggtcgggacgtacggcctgaacaccttcaccaacatggaggtgcagctcatccggcagatggagagcgaggggatcttcctgccctccgagctggagaccccgaacctcgccgagcgcgtgctggactggctggagaagcacggcgccgagcggctcaagcgcatggccatcagcggggacgactgcgtcgtgaagcccatcgacgaccggttcgccacggcgctgaccgccctgaacgacatgggcaaggtgcgcaaggacatcccccagtgggagccctccaagggctggaacgactggcagcaggtcccgttctgcagccaccacttccaccagctcatcatgaaggacgggcgggagatcgtggtgccctgccgcaaccaggacgagctggtcggccgggcccgcgtgtcccagggggccggctggagcctgcgggagaccgcctgcctcgggaagtcctacgcgcagatgtggcagctgatgtacttccaccgccgggacctgcgcctcgccgccaacgccatctgcagcgcggtgcccgtcgactgggtgcccacctcccggaccacgtggagcatccacgcccaccaccagtggatgaccaccgaggacatgctgagcgtgtggaaccgcgtctggatcgaggagaacccgtggatggaggacaagacccacgtgtccagctgggaggaggtgccctacctgggcaagcgcgaggaccagtggtgcggctccctcatcgggctgacggcccgggccacctgggccaccaacatccaggtcgcgatcaaccaggtgcgccggctgatcggcaacgagaactacctcgactacatgaccagcatgaagcgcttcaagaacgagtccgaccccgagggggccctgtggtga

SEQ ID NO: 8235 - RNA, 9879 nt, synthetic construct
  misc_feature 1..9879: note = derived and/or modified CDS sequence (opt1) from DENV-1__FJ639741__SS-prME
  source 1..9879: mol_type = other RNA
agcgtgaccatcctgctcatgctgctgcccaccgccctcgccttccacctgaccacccgcggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccgggaccagcaccagccaggagacgtggaaccggcaggacctcctggtgaccttcaagaccgcccacgccaagaagcaggaggtcgtggtgctgggctcccaggagggcgcgatgcacaccgccctcacgggggccaccgagatccagaccagcggcaccacgaccatcttcgccgggcacctgaagtgccgcctgaagatggacaagctcaccctgaagggcacctcctacgtcatgtgcacggggagcttcaagctggagaaggaggtggccgagacccagcacggcaccgtgctggtccaggtgaagtacgagggcaccgacgcgccctgcaagatccccttctccacgcaggacgagaagggggtgacccagaacggccggctcatcaccgccaacccgatcgtcaccgacaaggagaagcccgtgaacatcgagacggagccgcccttcggggagagctacatcgtggtcggcgccggcgagaaggccctgaagctgtcctggttcaagaaggggagctccatcggcaagatgttcgaggcgaccgcccgcggggcccggcgcatggccatcctcggcgacaccgcctgggacttcgggagcatcggcggcgtgttcacctccgtggggaagctggtccaccaggtgttcggcacggcgtacggggtgctgttcagcggcgtctcctggaccatgaagatcgggatcggcatcctcctgacctggctgggcctcaacagccgctccaccagcctgtccatgacgtgcatcgccgtggggatggtgaccctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgccgcgatcggcaaggcctgggaggagggggtgtgcggcatccggtccgccacgcgcctcgagaacatcatgtggaagcagatcagcaacgagctgaaccacatcctgctcgagaacgacatgaagttcaccgtcgtggtgggggacgccaacggcatcctggcccaggggaagaagatgatccggccccagcccatggagcacaagtactcctggaagtcctggggcaaggcgaagatcatcggcgccgacatccagaacaccaccttcatcatcgacgggcccgacacgccggagtgccccgacgaccagcgcgcctggaacatctgggaggtcgaggactacggcttcgggatcttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggccaaggcctccttcatcgaggtgaagacctgcatctggcccaagagccacaccctctggtccaacggcgtcctggagagcgagatgatcatccccaagatctacgggggcccgatctcccagcacaactaccggcccgggtacttcacccagacggcgggcccctggcacctggggaagctcgagctggacttcgacctgtgcgagggcaccaccgtggtggtcgacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtgaaggagaaggaggagaacctcgtccgcagcatggtgtccgccggcagcggcgaggtggacagcttctccctggggatcctgtgcgtcagcatcatgatcgaggaggtgatgcggtcccgctggagccggaagatgctcatgacgggcaccctggccgtgttcctgctcctgatcatggggcagctgacctggaacgacctcatccgcctgtgcatcatggtcggcgccaacgcctccgaccgcatggggatgggcaccacgtacctggcgctcatggccaccttcaagatgcggccgatgttcgccgtggggctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcacggagttccagccccaccagctgtggaccaccctgctcagcctgaccttcatcaagacgaccctgtccctcgactacgcgtggaagaccaccgccatggtcctgagcatcgtgtccctgttccccctctgcctgagcacgacctcccagaagaccacctggctgccggtgctcctgggcagcttcgggtgcaagcccctgaccatgttcctcatcacggagaacaagatctggggccggaagtcctggcccctgaacgaggggatcatggccatcggcatcgtcagcatcctgctctccagcctgctgaagaacgacgtgcccctcgccgggccgctgatcgcgggcggcatgctgatcgcctgctacgtgatcagcgggtccagcgccgacctctccctggagaaggccgccgaggtcagctgggagcaggaggcggagcactccggcaccagccacaacatcctggtggaggtgcaggacgacgggaccatgaagatcaaggacgaggagcgcgacgacaccctcacgatcctgctgaaggccaccctcctggccgtctccggcgtgtaccccatgagcatccccgccaccctgttcgtgtggtacttctggcagaagaagaagcagcggtccggggtcctctgggacacccccagcccgcccgaggtggagcgcgccgtgctggacgacggcatctaccggatcctgcagcgcggcctgctcgggcggtcccaggtcggcgtgggggtgttccaggacggcgtcttccacacgatgtggcacgtgacccgcggggcggtgctgatgtaccagggcaagcggctggagcccagctgggcctccgtcaagaaggacctcatcagctacggcgggggctggcgcttccaggggtcctggaacaccggcgaggaggtccaggtgatcgccgtcgagcccgggaagaacccgaagaacgtgcagaccacgcccggcaccttcaagacccccgagggcgaggtgggggccatcgccctggacttcaagcccggcaccagcgggtccccgatcgtcaaccgggagggcaagatcgtgggcctgtacgggaacggcgtggtcacgaccagcgggacctacgtgtccgcgatcgcccaggccaaggccagccaggagggccccctccccgagatcgaggacgaggtgttcaagaagcgcaacctgaccatcatggacctgcacccggggagcggcaagacgcggcgctacctccccgccatcgtccgggaggcgatcaagcgcaagctgcggaccctgatcctcgcccccacccgcgtggtggcctccgagatggccgaggcgctgaagggcatgcccatccgctaccagaccacggccgtcaagagcgagcacaccgggcgggagatcgtggacctgatgtgccacgccaccttcaccatgcgcctcctgtccccggtgcgggtccccaactacaacatgatcatcatggacgaggcccacttcacggaccccgccagcatcgcggcccgcggctacatctccacccgggtggggatgggcgaggccgccgccatcttcatgaccgcgacgccgcccgggagcgtggaggccttcccccagtccaacgccgtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggccaacttccgggcggaccgcgtcatcgacccccggcgctgcctgaagcccgtgatcctgaaggacggccccgagcgggtgatcctcgccgggccgatgcccgtcaccgtggccagcgccgcgcagcgccggggccgcatcggccggaaccagaacaaggagggggaccagtacgtctacatgggccagcccctgaacaacgacgaggaccacgcccactggacggaggccaagatgctgctcgacaacatcaacacccccgaggggatcatcccggccctgttcgagcccgagcgcgagaagtccgccgcgatcgacggcgagtaccgcctgcgcggggaggcccgcaagaccttcgtggagctcatgcggcgcggcgacctgcccgtgtggctgagctacaaggtcgcctccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgccctgcgcgagttcaaggagttcgcggccgggcggcgcagcgtcagcggcgacctgatcctcgagatcggcaagctgccccagcacctgacgctccgggcccagaacgccctggacaacctggtgatgctccacaactccgagcagggcgggaaggcctaccgccacgcgatggaggagctgcccgacaccatcgagaccctgatgctcctggccctgatcgccgtgctcaccgggggcgtcacgctgttcttcctgagcgggaagggcctcggcaagacctccatcgggctgctgtgcgtgaccgccagctccgcgctcctgtggatggccagcgtggagccccactggatcgccgcctccatcatcctggagttcttcctcatggtcctgctgatcccggagcccgaccggcagcgcacgccccaggacaaccagctcgcctacgtggtgatcggcctgctgttcatgatcctcacggtcgcggccaacgagatggggctgctggagaccaccaagaaggacctcggcatcgggcacgtggccgccgagaaccaccagcacgccaccatgctggacgtggacctgcggccggcgagcgcctggacgctctacgccgtcgccaccaccgtgatcacccccatgatgcgccacacgatcgagaacaccaccgccaacatctccctgaccgcgatcgccaaccaggccgccatcctgatgggcctcgacaagggctggcccatcagcaagatggacatcggggtgcccctgctggccctcggctgctactcccaggtcaacccgctgacgctgaccgcggccgtgctcatgctggtggcccactacgccatcatcgggcccggcctgcaggcgaaggccacccgggaggcccagaagcgcaccgccgccgggatcatgaagaaccccacggtcgacggcatcgtggcgatcgacctcgaccccgtggtctacgacgccaagttcgagaagcagctgggccagatcatgctgctcatcctgtgcaccagccagatcctgctcatgcgcaccacctgggccctgtgcgagtccatcacgctggccaccgggccgctcaccaccctgtgggagggcagccccgggaagttctggaacacgaccatcgccgtgtccatggcgaacatcttccggggcagctacctggccggcgccgggctcgccttctccctgatgaagtccctgggcgggggccgccgggggaccggcgcccagggcgagaccctcggggagaagtggaagcgccagctgaaccagctgtccaagagcgagttcaacacgtacaagcggagcggcatcatggaggtggaccgctccgaggcgaaggaggggctcaagcggggcgagaccaccaagcacgccgtcagccgcgggaccgccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacacgaagggcggcctggggcacgaggagcccatcccgatggcgacctacggctggaacctggtcaagctccacagcgggaaggacgtgttcttcatgccgcccgagaagtgcgacaccctgctgtgcgacatcggcgagtccagccccaacccgaccatcgaggaggggcgcacgctccgggtgctgaagatggtcgagccctggctgcgcggcaaccagttctgcatcaagatcctcaacccctacatgccctccgtggtggagaccctggagcagatgcagcggaagcacggcgggatgctggtccgcaacccgctcagccggaactccacccacgagatgtactgggtgagctgcggcaccgggaacatcgtgtccgccgtcaacatgacgagccgcatgctgctgaaccggttcaccatggcccaccgcaagcccacctacgagcgcgacgtggacctcggcgccggcacccggcacgtggccgtcgagcccgaggtggcgaacctggacatcatcgggcagcgcatcgagaacatcaagaacgagcacaagtccacgtggcactacgacgaggacaacccctacaagacctgggcctaccacggcagctacgaggtgaagccgtccgggagcgcctccagcatggtcaacggcgtggtcaagctgctcaccaagccctgggacgtgatccccatggtgacccagatcgccatgacggacaccacccccttcgggcagcagcgggtcttcaaggagaaggtggacacccgcacgccgcgggccaagcgcggcaccacccagatcatggaggtgaccgcgaagtggctgtggggcttcctgtcccggaacaagaagccccgcatctgcacgcgggaggagttcacccgcaaggtccggagcaacgccgccatcggggccgtgttcgtggacgagaaccagtggaacagcgccaaggaggcggtcgaggacgagcgcttctggaacctcgtgcaccgggagcgcgagctgcacaagcagggcaagtgcgcgacctgcgtgtacaacatgatggggaagcgggagaagaagctgggcgagttcgggaaggccaagggctcccgcgccatctggtacatgtggctcggcgcgcggttcctggagttcgaggccctggggttcatgaacgaggaccactggttcagccgcgagaactccctcagcggcgtcgagggggagggcctgcacaagctggggtacatcctccgggacatctccaagatccccggcggcaacatgtacgccgacgacaccgccgggtgggacacgcgcatcaccgaggacgacctgcagaacgaggccaagatcaccgacatcatggagccggagcacgcgctgctcgccaccagcatcttcaagctgacgtaccagaacaaggtggtgcgggtccagcgccccgccaagaacggcaccgtgatggacgtgatctcccgccgggaccagcgcgggagcggccaggtcggcacctacgggctgaacaccttcacgaacatggaggtgcagctcatccggcagatggagtccgagggcatcttcctgcccagcgagctggagacccccaacctcgccgagcgcgtgctggactggctggagaagcacggggccgagcggctcaagcgcatggcgatctccggcgacgactgcgtcgtgaagccgatcgacgaccggttcgccaccgccctgaccgccctgaacgacatggggaaggtgcgcaaggacatcccccagtgggagcccagcaagggctggaacgactggcagcaggtccccttctgctcccaccacttccaccagctcatcatgaaggacggccgggagatcgtggtgccgtgccgcaaccaggacgagctggtcgggcgggcccgcgtgagccagggcgcggggtggtccctgcgggagaccgcctgcctcggcaagagctacgcccagatgtggcagctgatgtacttccaccgccgggacctgcgcctcgccgccaacgcgatctgctccgccgtgcccgtcgactgggtgcccacgagccggaccacctggagcatccacgcccaccaccagtggatgaccacggaggacatgctgtccgtgtggaaccgcgtctggatcgaggagaacccctggatggaggacaagacccacgtgagctcctgggaggaggtgccgtacctggggaagcgggaggaccagtggtgcggcagcctcatcggcctgaccgcccgcgcgacctgggccacgaacatccaggtcgccatcaaccaggtgcgccggctgatcgggaacgagaactacctcgactacatgacctccatgaagcgcttcaagaacgagagcgaccccgagggcgccctgtggtga

SEQ ID NO: 8236 - RNA, 9879 nt, synthetic construct
  misc_feature 1..9879: note = derived and/or modified CDS sequence (opt1) from DENV-1__FJ639743__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatggccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgcggtacgagggcaccgacgccccctgcaagatccccttctccacccaggacgagaagggggtgacccagaacggccgcctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccgccgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccggtccaccagcctgtccatgacctgcatcgccgtggggatggtgaccctgtacctcggcgtcatggtgcaggccgacagcgggtgcgtgatcaactggaagggccgcgagctgaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcaccgtcgtggtgggggacgccaacggcatcctggcgcaggggaagaagatgatccgcccccagcccatggagcacaagtactcctggaagtcctggggcaaggccaaggtcatcggcgccgacatccagaacacgaccttcatcatcgacgggcccgacaccccggagtgccccgacggccagcgggcctggaacatctgggaggtggaggactacgggttcggcatcttcaccacgaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctctggtccaacggggtgctggagagcgagatgatcatccccaagatctacggcgggccgatctcccagcacaactaccggcccggctacttcacccagaccgccgggccctggcacctgggcaagctcgagctggacttcgacctgtgcgagggcacgaccgtggtcgtggacgagcactgcgggaaccgcggcccgagcctccggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctcgtgcgcagcatggtgtccgccggcagcggggaggtcgacagcttctccctgggcatcctgtgcgtgagcatcatgatcgaggaggtgatgcggtcccgctggagccgcaagatgctcatgaccgggacgctggccgtcttcctgctcctggtgatgggccagctgacctggaacgacctcatccggctgtgcatcatggtgggggccaacgcgtccgaccgcatgggcatgggcaccacctacctggccctcatggccacgttcaagatgcggccgatgttcgccgtcgggctgctgttccgccggctcaccagccgcgaggtgctgctgctcaccatcgggctgtccctggtcgccagcgtggagctccccaactccctggaggagctgggggacggcctcgcgatgggcatcatgatgctgaagctgctcaccgagttccagccccaccagctgtggacgaccctgctcagcctgaccttcgtgaagaccacgctgtccctcgactacgcctggaagaccaccgccatggtcctgagcatcgtgtccctgttccccctctgcctgagcaccacgtcccagaagaccacctggctgccggtgctcctggggagcttcggctgcaagcccctgaccatgttcctcatcaccgagaacaagatctgggggcggaagtcctggcccctgaacgagggcatcatggccatcgggatcgtcagcatcctgctctccagcctgctgaagaacgacgtgcccctcgcgggcccgctgatcgccggcgggatgctgatcgcctgctacgtgatcagcggctccagcgccgacctctccctggagaaggccgcggaggtcagctgggagcaggaggccgagcactccggggccagccacaacatcctggtggaggtgcaggacgacggcacgatgaagatcaaggacgaggagcgcgacgacaccctcaccatcctgctgaaggccaccctcctggccgtctccggggtgtaccccatgagcatccccgcgacgctgttcgtgtggtacttctggcagaagaagaagcagcggtccggcgtcctctgggacacccccagcccgcccgaggtggagcgcgccgtgctggacgacggcatctaccggatcctgcagcgcgggctgctcggccggtcccaggtcggggtgggcgtgttccaggacggggtcttccacaccatgtggcacgtgacccgcggcgccgtgctgatgtaccagggcaagcggctggagcccagctgggcctccgtcaagaaggacctcatcagctacgggggcgggtggcgcttccagggctcctggaacacgggggaggaggtccaggtgatcgccgtcgagcccggcaagaacccgaagaacgtgcagaccacccccggcaccttcaagacgagcgagggggaggtgggcgcgatcgccctggacttcaagcccgggacctccggcagccccatcgtcaaccgggagggcaagatcgtggggctgtacggcaacggggtggtcaccacctccggcacgtacgtgagcgccatcgcccaggccaaggcgagccaggaggggccgctccccgagatcgaggacgaggtgttcaagaagcgcaacctgaccatcatggacctgcaccccggctccggcaagacccggcgctacctcccggccatcgtccgggaggccatcaagcgcaagctgcgcaccctgatcctcgcccccacgcgggtggtggcgagcgagatggccgaggccctgaaggggatgcccatccgctaccagaccaccgccgtcaagtccgagcacaccggccgggagatcgtggacctgatgtgccacgccacgttcaccatgcgcctcctgagccccgtgcgggtcccgaactacaacatgatcatcatggacgaggcgcacttcaccgaccccgcctccatcgccgcccgcgggtacatcagcacccgggtgggcatgggggaggccgcggccatcttcatgacggccacgccgcccggctccgtggaggccttcccgcagagcaacgccgtcatccaggacgaggagcgcgacatccccgagcggtcctggaacagcggctacgactggatcaccgacttccccgggcgcaccgtgtggttcgtgccctccatcaagagcggcaacgacatcgcgaactgcctgcggaagaacgggaagcgcgtcatccagctctcccggaagacgttcgacaccgagtaccagaagaccaagaacaacgactgggactacgtggtgaccacggacatcagcgagatgggcgccaacttccgcgccgaccgggtcatcgacccgcgccggtgcctgaagcccgtgatcctgaaggacgggcccgagcgcgtcatcctcgccggccccatgccggtgaccgtggcgtccgccgcccagcggcgcggccgcatcgggcggaaccagaacaaggagggcgaccagtacgtctacatggggcagcccctgaacaacgacgaggaccacgcccactggaccgaggccaagatgctgctcgacaacatcaacacccccgagggcatcatccccgcgctgttcgagccggagcgcgagaagtccgccgccatcgacggggagtaccggctgcgcggcgaggcccggaagacgttcgtggagctcatgcgccggggcgacctgcccgtgtggctgtcctacaaggtcgccagcgaggggttccagtactccgaccgccggtggtgcttcgacggcgagcgcaacaaccaggtgctcgaggagaacatggacgtggagatctggaccaaggagggggagcggaagaagctgcgcccccggtggctggacgcgcgcacctacagcgaccccctcgccctgcgggagttcaaggagttcgccgccggccgccggagcgtctccggcgacctgatcctcgagatcgggaagctgccgcagcacctgaccctccgcgcccagaacgcgctggacaacctggtgatgctccacaacagcgagcagggcgggaaggcctaccggcacgccatggaggagctgcccgacaccatcgagacgctgatgctcctggccctgatcgcggtgctcaccggcggggtcaccctgttcttcctgtccggcaagggcctcgggaagaccagcatcggcctgctgtgcgtgacggcctccagcgccctcctgtggatggcctccgtggagccccactggatcgccgcgagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccacgaagaaggacctcgggatcggctacgtggccgcggagaaccaccagcacgccaccatgctggacgtggacctgcgccccgcctccgcctggaccctctacgccgtcgcgaccacggtgatcaccccgatgatgcgccacaccatcgagaacaccacggccaacatcagcctgaccgccatcgccaaccaggccgcgatcctgatgggcctcgacaaggggtggcccatctccaagatggacatcggcgtgcccctgctggccctcgggtgctacagccaggtcaaccccctgaccctgaccgccgccgtgctcatgctggtggcgcactacgccatcatcggcccggggctgcaggccaaggccacgcgggaggcccagaagcgcaccgcggccggcatcatgaagaaccccaccgtcgacggcatcgtggccatcgacctcgaccccgtggtctacgacgccaagttcgagaagcagctggggcagatcatgctgctcatcctgtgcacctcccagatcctgctcatgcggacgacctgggccctgtgcgagagcatcaccctggcgaccggccccctcacgaccctgtgggaggggtccccgggcaagttctggaacaccaccatcgccgtgagcatggccaacatcttccgcggctcctacctggccggggccggcctcgcgttcagcctgatgaagtccctcgggggcgggcggcgcgggacgggcgcccagggggagaccctcggcgagaagtggaagcggcagctgaaccagctgagcaagagcgagttcaacacctacaagcgctccgggatcatggaggtggaccggagcgaggccaaggagggcctcaagcgcggggagaccacgaagcacgccgtctcccggggcaccgcgaagctgcgctggttcgtggagcggaacctggtgaagcccgagggcaaggtcatcgacctggggtgcggccgcgggggctggagctactactgcgccgggctcaagaaggtgaccgaggtgaagggctacaccaagggcgggcccggccacgaggagcccatcccgatggccacctacgggtggaacctggtcaagctgcactccggcaaggacgtgttcttcatgagccccgagaagtgcgacacgctcctgtgcgacatcggggagtccagccccaaccccaccatcgaggagggccggaccctgcgcgtgctcaagatggtcgagccgtggctgcggggcaaccagttctgcatcaagatcctgaacccctacatgccctccgtggtggagaccctcgagcagatgcagcgcaagcacgggggcatgctggtccggaaccccctgagccgcaactccacgcacgagatgtactgggtgagctgcgggaccggcaacatcgtgtccgccgtcaacatgaccagccgcatgctcctgaaccggttcaccatggcccaccgcaagccgacgtacgagcgggacgtggacctgggcgcggggacccgccacgtggccgtcgagcccgaggaggccaacctcgacatcatcggccagcggatcgagaacatccgcaacgagcacaagtccacctggcactacgacgaggacaacccctacaagacctgggcctaccacgggagctacgaggtgaagccctccggcagcgcctccagcatggtcaacggggtggtgcggctgctgacgaagccgtgggacgtcatccccatggtgacccagatcgcgatgaccgacaccacgcccttcggccagcagcgcgtgttcaaggagaaggtcgacacccggacgccccgcgccaagcggggcaccacgcagatcatggaggtgaccgccaagtggctctgggggttcctgagccgcaacaagaagccgcggatctgcacccgcgaggagttcacccggaaggtgcgctccaacgccgccatcggcgcggtcttcgtggacgagaaccagtggaacagcgccaaggaggccgtggaggacgagcggttctgggacctggtccaccgcgagcgggagctccacaagcaggggaagtgcgccacgtgcgtgtacaacatgatgggcaagcgcgagaagaagctgggggagttcggcaaggcgaagggctcccgggccatctggtacatgtggctgggggcccgcttcctcgagttcgaggccctgggcttcatgaacgaggaccactggttcagccgcgagaactccctgagcggggtggagggcgaggggctccacaagctgggctacatcctgcgggacatctccaagatccccggcgggaacatgtacgccgacgacaccgcgggctgggacacccgcatcaccgaggacgacctccagaacgaggccaagatcacggacatcatggagcccgagcacgccctgctggccaccagcatcttcaagctcacctaccagaacaaggtcgtgcgggtgcagcgcccggccaagaacgggaccgtcatggacgtgatctcccggcgcgaccagcggggcagcggccaggtggggacgtacggcctgaacaccttcaccaacatggaggtccagctgatccgccagatggagtccgaggggatcttcctccccagcgagctggagacccccaacctggcggagcgggtgctcgactggctggagaagcacggcgccgagcgcctgaagcggatggccatctccggggacgactgcgtggtcaagcccatcgacgaccgcttcgccacggccctcaccgcgctgaacgacatgggcaaggtgcggaaggacatcccgcagtgggagcccagcaagggctggaacgactggcagcaggtccccttctgctcccaccacttccaccagctgatcatgaaggacgggcgcgagatcgtcgtgccctgccggaaccaggacgagctcgtgggccgcgcccgggtcagccagggggccggctggtccctgcgcgagaccgcctgcctgggcaagagctacgcccagatgtggcagctcatgtacttccaccggcgcgacctgcgcctggcggccaacgccatctgcagcgccgtgccggtggactgggtccccacctcccggaccacgtggagcatccacgcgcaccaccagtggatgaccaccgaggacatgctctccgtgtggaaccgcgtgtggatcgaggagaacccctggatggaggacaagacccacgtcagctcctgggaggaggtgccctacctgggcaagcgggaggaccagtggtgcggcagcctgatcgggctcacggcccgcgccacctgggccaccaacatccaggtggccatcaaccaggtccggcgcctgatcggcaacgagaactacctggactacatgacctccatgaagcggttcaagaacgagagcgacccggagggggcgctctggtga

SEQ ID NO: 8237 - RNA, 9879 nt, synthetic construct
  misc_feature 1..9879: note = derived and/or modified CDS sequence (opt1) from DENV-1__FJ639794__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgtggtggggatggtcaccctgtacctcggcgtgatggtgcaggccgacagcgggtgcgtcatcaactggaagggccgggagctgaagtgcgggtccggcatcttcgtgacgaacgaggtgcacacctggaccgagcagtacaagttccaggccgacagcccgaagcgcctgagcgccgcgatcggcaaggcctgggaggagggggtctgcggcatccggtccgccacccgcctcgagaacatcatgtggaagcagatcagcaacgagctgaaccacatcctgctcgagaacgacatgaagttcaccgtggtggtcggggacgccaacggcatcctggcccaggggaagaagatgatccggccccagcccatggagcacaagtactcctggaagtcctggggcaaggcgaagatcatcggcgccgacatccagaacacgaccttcatcatcgacgggcccgacaccccggagtgccccgacggccagcgcgcctggaacatctgggaggtggaggactacgggttcggcatcttcaccacgaacatctggctgaagctccgggactcctacacccagatgtgcgaccaccgcctgatgagcgccgcgatcaaggactccaaggccgtgcacgccgacatgggctactggatcgagagcgagaagaacgagacctggaagctggcccgggcctccttcatcgaggtcaagacctgcacgtggcccaagagccacaccctctggtccaacggggtgctggagagcgagatgatcatccccaagatctacggcgggccgatctcccagcacaactaccgccccggctacttcacccagaccgcggggccctggcacctgggcaagctcgagctggacttcgacctgtgcgagggcacgaccgtggtcgtggacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtcaaggagaaggaggagaacctcgtgcggagcatggtgtccgccggcagcggggaggtcgacagcttctccctgggcatcctgtgcgtgagcatcatgatcgaggaggtgatgcgctcccggtggagccgcaagatgctcatgaccgggacgctggccgtcttcctgctcctgatcatgggccagctgacctggaacgacctcatccgcctgtgcatcatggtgggggccaacgcctccgaccggatgggcatgggcaccacctacctggcgctcatggccacgttcaagatgcgcccgatgttcgccgtggggctgctgttccggcgcctcaccagccgggaggtcctgctgctcaccatcgggctgtccctggtggccagcgtcgagctccccaactccctggaggagctgggggacggcctcgccatgggcatcatgatgctgaagctgctcaccgagttccagccccaccagctgtggacgaccctgctcagcctgaccttcgtgaagaccacgctgtccctcgactacgcgtggaagaccaccgccatggtgctgagcatcgtctccctgttccccctctgcctgagcaccacgtcccagaagaccacctggctgccggtgctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtccccctcgccggcccgctgatcgcgggcgggatgctgatcgcctgctacgtgatcagcggctccagcgccgacctctccctggagaaggccgccgaggtgagctgggagcaggaggcggagcactccggggccagccacaacatcctggtcgaggtgcaggacgacggcacgatgaagatcaaggacgaggagcgggacgacaccctcaccatcctgctgaaggccaccctcctggccgtgtccggggtctaccccatgagcatccccgccacgctgttcgtgtggtacttctggcagaagaagaagcagcgctccggcgtgctctgggacacccccagcccgcccgaggtcgagcgggcggtgctggacgacggcatctaccgcatcctgcagcgggggctgctcggccgctcccaggtgggggtcggcgtgttccaggacggggtgttccacaccatgtggcacgtcacccggggcgccgtgctgatgtaccagggcaagcgcctggagcccagctgggcctccgtgaagaaggacctcatcagctacgggggcgggtggcggttccagggctcctggaacacgggggaggaggtccaggtgatcgccgtggagcccggcaagaacccgaagaacgtccagaccacccccggcaccttcaagacgcccgagggggaggtgggcgccatcgcgctggacttcaagcccgggaccagcggctccccgatcgtgaaccgcgagggcaagatcgtcgggctgtacggcaacggggtggtgaccaccagcggcacgtacgtctccgccatcgcccaggccaaggccagccaggaggggcccctccccgagatcgaggacgaggtgttcaagaagcggaacctgaccatcatggacctgcacccgggcagcggcaagacccgccggtacctccccgcgatcgtgcgcgaggccatcaagcggaagctgcgcaccctgatcctcgcccccacgcgcgtcgtggcctccgagatggcggaggccctgaaggggatgcccatccggtaccagaccaccgccgtcaagagcgagcacaccggccgcgagatcgtcgacctgatgtgccacgccacgttcaccatgcggctcctgtccccggtgcgcgtgcccaactacaacatgatcatcatggacgaggcccacttcaccgaccccgcgagcatcgccgcccgggggtacatctccacccgcgtcggcatgggggaggccgccgcgatcttcatgacggccacgccgcccggcagcgtggaggccttcccccagtccaacgccgtgatccaggacgaggagcgggacatccccgagcgcagctggaacctgggctacgactggatcaccgacttccccgggaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgcgaacttccgcgccgaccgggtgatcgacccccgccggtgcctgaagcccgtcatcctcaaggacgggcccgagcgcgtgatcctggccggcccgatgcccgtcaccgtggcctccgcggcccagcggcgcggccggatcgggcgcaaccagaacaaggagggcgaccagtacgtgtacatggggcagcccctgaacaacgacgaggaccacgcccactggaccgaggccaagatgctcctggacaacatcaacacccccgagggcatcatcccggccctgttcgagcccgagcgcgagaagtccgcggccatcgacggggagtaccggctccgcggcgaggcccggaagacgttcgtcgagctgatgcgccggggcgacctgcccgtgtggctctcctacaaggtggccagcgaggggttccagtactccgaccgccggtggtgcttcgacggcgagcgcaacaaccaggtcctggaggagaacatggacgtggagatctggaccaaggagggggagcggaagaagctgcgcccccggtggctcgacgcccgcacctacagcgacccgctggcgctgcgggagttcaaggagttcgccgccggccgccggtccgtgagcggcgacctcatcctggagatcgggaagctgccccagcacctcaccctgcgcgcccagaacgccctggacaacctcgtcatgctgcacaacagcgagcagggcgggaaggcgtaccggcacgccatggaggagctgcccgacaccatcgagacgctcatgctgctggccctcatcgccgtgctgaccggcggggtgaccctgttcttcctctccggcaagggcctggggaagaccagcatcggcctgctctgcgtcacggcgtccagcgccctgctgtggatggcctccgtggagccccactggatcgccgccagcatcatcctcgagttcttcctgatggtgctgctcatcccggagcccgaccgccagcggacgccccaggacaaccagctggcgtacgtcgtgatcgggctcctcttcatgatcctgaccgtggccgccaacgagatgggcctgctcgagaccacgaagaaggacctggggatcggctacgtcgccgccgagaaccaccagcacgcgaccatgctggacgtggacctccgcccggcctccgcctggaccctgtacgccgtggccaccacggtcatcacccccatgatgcggcacaccatcgagaacaccacggcgaacatcagcctgaccgccatcgccaaccaggccgccatcctcatgggcctggacaaggggtggcccatctccaagatggacatcggcgtgcccctgctcgcgctggggtgctacagccaggtgaacccgctgaccctcaccgccgccgtcctgatgctggtggcccactacgcgatcatcggccccgggctccaggccaaggccacgcgcgaggcccagaagcgcaccgccgcgggcatcatgaagaaccccaccgtggacggcatcgtcgccatcgacctggaccccgtggtgtacgacgccaagttcgagaagcagctggggcagatcatgctcctgatcctgtgcacctcccagatcctcctgatgcggacgacctgggccctgtgcgagagcatcaccctcgccaccggcccgctgacgaccctgtgggaggggtcccccggcaagttctggaacaccaccatcgcggtcagcatggccaacatcttccgcggctcctacctcgccggggccggcctggccttcagcctgatgaagtccctcgggggcgggcggcgcggcacgggcgcgcagggggagaccctgggcgagaagtggaagcggcagctgaaccagctcagcaagtccgagttcaacacctacaagcgcagcgggatcatggaggtggaccggagcgaggccaaggagggcctgaagcgcggggagaccacgaagcacgccgtgtcccggggcaccgccaagctgcgctggttcgtcgagcggaacctggtgaagcccgagggcaaggtgatcgacctcgggtgcggccgcgggggctggagctactactgcgcggggctgaagaaggtcaccgaggtgaagggctacaccaagggcgggcccggccacgaggagccgatccccatggccacctacgggtggaacctggtgaagctccactccggcaaggacgtcttcttcatgccgcccgagaagtgcgacacgctgctgtgcgacatcggggagagctccccgaaccccaccatcgaggagggccggaccctccgcgtgctgaagatggtggagccctggctgaagggcaaccagttctgcatcaagatcctcaacccctacatgccgagcgtcgtggagaccctggagcagatgcagcggaagcacgggggcatgctggtgcgcaaccccctctcccggaacagcacgcacgagatgtactgggtctcctgcgggaccggcaacatcgtgagcgccgtgaacatgacctcccgcatgctgctgaaccggttcaccatggtccaccgcaagcccacgtacgagcgcgacgtggacctcggcgccgggacccggcacgtggccgtcgagcccgaggtggcgaacctggacatcatcggccagcgcatcgagaacatcaagaacgagcacaagagcacctggcactacgacgaggacaacccgtacaagacctgggcctaccacgggtcctacgaggtcaagcccagcggctccgccagctccatggtgaacggggtggtccggctgctcacgaagccctgggacgtgatccccatggtgacccagatcgccatgaccgacaccacgccgttcggccagcagcgcgtcttcaaggagaaggtggacacccggacgccccgcgccaagcggggcaccacgcagatcatggaggtgaccgcgaagtggctgtgggggttcctgagccgcaacaagaagccccggatctgcacccgcgaggagttcacccggaaggtccgctccaacgccgccatcggcgccgtgttcgtggacgagaaccagtggaacagcgccaaggaggcggtcgaggacgagcggttctgggacctcgtgcaccgcgagcgggagctgcacaagcaggggaagtgcgccacgtgcgtgtacaacatgatgggcaagcgcgagaagaagctgggggagttcggcaaggccaagggcagccgggccatctggtacatgtggctcggggcgcgcttcctggagttcgaggccctgggcttcatgaacgaggaccactggttctcccgggagaacagcctctccggggtcgagggcgaggggctgcacaagctgggctacatcctccgcgacatcagcaagatcccgggcgggaacatgtacgccgacgacaccgccggctgggacacccggatcaccgaggacgacctgcagaacgaggccaagatcacggacatcatggagcccgagcacgcgctgctcgccacctccatcttcaagctgacctaccagaacaaggtggtgcgcgtccagcgccccgccaagaacgggaccgtgatggacgtgatcagccggcgcgaccagcggggctccggccaggtcgggacgtacggcctgaacaccttcaccaacatggaggtgcagctcatccgccagatggagagcgaggggatcttcctgccctccgagctggagaccccgaacctcgccgagcgggtgctggactggctggagaagcacggcgccgagcgcctcaagcggatggcgatcagcggggacgactgcgtcgtgaagcccatcgacgaccgcttcgccacggccctgaccgccctgaacgacatgggcaaggtgcggaaggacatcccccagtgggagccctccaagggctggaacgactggcagcaggtcccgttctgcagccaccacttccaccagctcgtgatgaaggacgggcgcgagatcgtggtcccctgccggaaccaggacgagctggtgggccgcgcccgggtgtcccagggggcgggctggagcctgcgcgagaccgcctgcctcgggaagtcctacgcccagatgtggcagctgatgtacttccaccggcgcgacctgcggctcgccgccaacgcgatctgcagcgccgtccccgtggactgggtgcccacctcccgcaccacgtggagcatccacgcccaccaccagtggatgaccaccgaggacatgctgagcgtctggaaccgggtgtggatcgaggagaacccgtggatggaggacaagacccacgtgtccagctgggaggaggtcccctacctgggcaagcgcgaggaccagtggtgcggctccctcatcgggctgacggcccgcgcgacctgggccaccaacatccaggtggccatcaaccaggtgcggcgcctgatcggcaacgagaactacctcgactacatgaccagcatgaagcggttcaagaacgagtccgaccccgagggggccctgtggtga

SEQ ID NO: 8238 - RNA, 9879 nt, synthetic construct
  misc_feature 1..9879: note = derived and/or modified CDS sequence (opt1) from DENV-1__FJ639796__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacctacctggccctcatggccacgttcaagatgcgcccgatgttcgccgtggggctgctgttccggcgcctcaccagccgggaggtgctgctgctcaccatcgggctgtccctggtcgccagcgtggagctccccaactccctggaggagctgggggacggcctcgcgatgggcatcatgatgctgaagctgctcaccgagttccagccccaccagctgtggacgaccctgctcagcctgaccttcgtcaagaccacgctgtccctcgactacgcctggaagaccaccgccatggtgctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcacgatgaagatcaaggacgaggagcgggacgacaccctcaccatcctgctgaaggccaccctcctggccgtgtccggggtgtaccccatgagcatccccgcgacgctgttcgtctggtacttctggcagaagaagaagcagcgctccggcgtgctctgggacacccccagcccgcccgaggtggagcgggccgtcctggacgacggcatctaccgcatcctgcagcgggggctgctcggccgctcccaggtgggggtgggcgtcttccaggacggggtgttccacaccatgtggcacgtgacccggggcgccgtcctgatgtaccagggcaagcgcctggagcccagctgggcctccgtgaagaaggacctcatcagctacgggggcgggtggcggttccagggctcctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggaccagcggctccccgatcgtgaaccgcgagggcaagatcgtggggctgtacggcaacggggtcgtgaccaccagcggcacgtacgtgtccgccatcgcccaggccaaggcgagccaggaggggcccctccccgagatcgaggacgaggtcttcaagaagcggaacctgaccatcatggacctgcacccgggcagcggcaagacccgccggtacctccccgccatcgtgcgcgaggccatcaagcggaagctgcgcaccctgatcctcgcccccacgcgcgtggtcgcgtccgagatggccgaggccctgaaggggatgcccatccggtaccagaccaccgccgtcaagagcgagcacaccggccgcgagatcgtggacctgatgtgccacgccacgttcaccatgcggctcctgtccccggtccgcgtgcccaactacaacatgatcatcatggacgaggcgcacttcaccgaccccgccagcatcgccgcccgggggtacatctccacccgcgtgggcatgggggaggccgcggccatcttcatgacggccacgccgcccggcagcgtcgaggccttcccccagtccaacgccgtgatccaggacgaggagcgggacatccccgagcgcagctggaactccggctacgactggatcaccgacttccccgggaagaccgtgtggttcgtccccagcatcaagtccggcaacgacatcgcgaactgcctgcggaagaacgggaagcgcgtgatccagctcagccggaagacgttcgacaccgagtaccagaagaccaagaacaacgactgggactacgtggtcaccacggacatctccgagatgggcgccaacttccgcgccgaccgggtgatcgacccccgccggtgcctgaagcccgtgatcctgaaggacgggcccgagcgcgtcatcctcgccggcccgatgcccgtgaccgtcgcgagcgccgcccagcggcgcggccggatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagacgttcgtggagctcatgcgccggggcgacctgcccgtctggctgagctacaaggtggcctccgaggggttccagtacagcgaccgccggtggtgcttcgacggcgagcgcaacaaccaggtgctcgaggagaacatggacgtcgagatctggaccaaggagggggagcggaagaagctgcgcccccggtggctggacgcgcgcacctactccgacccgctcgccctgcgggagttcaaggagttcgccgccggccgccggagcgtgagcggcgacctgatcctcgagatcgggaagctgccccagcacctgaccctccgcgcccagaacgcgctggacaacctggtgatgctccacaactccgagcagggcgggaaggcctaccggcacgccatggaggagctgcccgacaccatcgagacgctgatgctcctggccctgatcgcggtcctcaccggcggggtgaccctgttcttcctgagcggcaagggcctcgggaagacctccatcggcctgctgtgcgtgacggccagctccgccctcctgtggatggccagcgtcgagccccactggatcgccgcgtccatcatcctggagttcttcctcatggtgctgctgatcccggagcccgaccgccagcggacgccccaggacaaccagctcgcctacgtggtcatcgggctgctgttcatgatcctcaccgtggccgccaacgagatgggcctgctggagaccacgaagaaggacctcgggatcggctacgtggccgcggagaaccaccagcacgccaccatgctggacgtcgacctgcgcccggccagcgcctggaccctctacgccgtggcgaccacggtgatcacccccatgatgcggcacaccatcgagaacaccacggccaacatctccctgaccgccatcgccaaccaggccgcgatcctgatgggcctcgacaaggggtggcccatcagcaagatggacatcggcgtccccctgctggccctcgggtgctactcccaggtgaacccgctgaccctgaccgccgccgtgctcatgctggtcgcgcactacgccatcatcggccccgggctgcaggccaaggccacgcgcgaggcccagaagcgcaccgcggccggcatcatgaagaaccccaccgtggacggcatcgtggccatcgacctcgaccccgtcgtgtacgacgccaagttcgagaagcagctggggcagatcatgctgctcatcctgtgcaccagccagatcctgctcatgcggacgacctgggccctgtgcgagtccatcaccctggcgaccggcccgctcacgaccctgtgggaggggagccccggcaagttctggaacaccaccatcgccgtgtccatggccaacatcttccgcggcagctacctggccggggccggcctcgcgttctccctgatgaagtccctcgggggcgggcggcgcgggacgggcgcccagggggagaccctcggcgagaagtggaagcggcagctgaaccagctgtccaagagcgagttcaacacctacaagcgcagcgggatcatggaggtcgaccggtccgaggccaaggagggcctcaagcgcggggagaccacgaagcacgccgtgagccggggcaccgcgaagctgcgctggttcgtggagcggaacctggtcaagcccgagggcaaggtgatcgacctggggtgcggccgcgggggctggtcctactactgcgccgggctcaagaaggtgaccgaggtcaagggctacaccaagggcgggcccggccacgaggagccgatccccatggccacctacgggtggaacctggtgaagctgcacagcggcaaggacgtgttcttcatgccgcccgagaagtgcgacacgctcctgtgcgacatcggggagtccagcccgaaccccaccatcgaggagggccggaccctgcgcgtcctcaagatggtggagccctggctgaagggcaaccagttctgcatcaagatcctgaacccctacatgccgtccgtggtcgagaccctcgagcagatgcagcggaagcacgggggcatgctggtgcgcaaccccctgagccggaactccacgcacgagatgtactgggtgagctgcgggaccggcaacatcgtctccgccgtgaacatgaccagccgcatgctcctgaaccggttcaccatggcccaccgcaagcccacgtacgagcgcgacgtggacctgggcgcggggacccggcacgtcgccgtggagcccgaggtggccaacctcgacatcatcggccagcgcatcgagaacatcaagaacgagcacaagtccacctggcactacgacgaggacaacccgtacaagacctgggcctaccacgggagctacgaggtcaagccctccggcagcgcctccagcatggtgaacggggtcgtgcggctgctgacgaagccctgggacgtgatccccatggtcacccagatcgcgatgaccgacaccacgccgttcggccagcagcgcgtgttcaaggagaaggtggacacccggacgccccgcgccaagcggggcaccacgcagatcatggaggtcaccgccaagtggctctgggggttcctgtcccgcaacaagaagccccggatctgcacccgcgaggagttcacccggaaggtgcgcagcaacgccgccatcggcgcggtgttcgtcgacgagaaccagtggaacagcgccaaggaggccgtggaggacgagcggttctgggacctggtgcaccgcgagcgggagctccacaagcaggggaagtgcgccacgtgcgtctacaacatgatgggcaagcgcgagaagaagctgggggagttcggcaaggcgaagggctcccgggccatctggtacatgtggctgggggcccgcttcctcgagttcgaggccctgggcttcatgaacgaggaccactggttcagccgggagaactccctgagcggggtggagggcgaggggctccacaagctgggctacatcctgcgcgacatctccaagatcccgggcgggaacatgtacgccgacgacaccgcgggctgggacacccggatcaccgaggacgacctccagaacgaggccaagatcacggacatcatggagcccgagcacgccctgctggccaccagcatcttcaagctcacctaccagaacaaggtggtccgcgtgcagcgccccgccaagaacgggaccgtgatggacgtcatctcccggcgcgaccagcggggcagcggccaggtggggacgtacggcctgaacaccttcaccaacatggaggtgcagctgatccgccagatggagtccgaggggatcttcctccccagcgagctggagaccccgaacctggcggagcgggtcctcgactggctggagaagcacggcgccgagcgcctgaagcggatggccatctccggggacgactgcgtggtgaagcccatcgacgaccgcttcgccacggccctcaccgcgctgaacgacatgggcaaggtccggaaggacatcccccagtgggagcccagcaagggctggaacgactggcagcaggtcccgttctgctcccaccacttccaccagctgatcatgaaggacgggcgcgagatcgtggtcccctgccggaaccaggacgagctcgtgggccgcgcccgggtgagccagggggccggctggtccctgcgcgagaccgcctgcctgggcaagagctacgcccagatgtggcagctcatgtacttccaccggcgcgacctgcggctggcggccaacgccatctgctccgccgtccccgtggactgggtgcccaccagccgcaccacgtggagcatccacgcgcaccaccagtggatgaccaccgaggacatgctctccgtctggaaccgggtgtggatcgaggagaacccgtggatggaggacaagacccacgtgagctcctgggaggaggtcccctacctgggcaagcgcgaggaccagtggtgcggcagcctgatcgggctcacggcccgcgccacctgggccaccaacatccaggtggccatcaaccaggtgcggcgcctgatcggcaacgagaactacctggactacatgacctccatgaagcggttcaagaacgagagcgaccccgagggggcgctctggtga

SEQ ID NO: 8239 - RNA, 9879 nt, synthetic construct
  misc_feature 1..9879: note = derived and/or modified CDS sequence (opt1) from DENV-1__FJ639797__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgccggggtgaacatgtgcaccctgatcgccatggacctgggcgagctctgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggccgggcctgggaggagggggtgtgcggcatccgctccgccacccggctcgagaacatcatgtggaagcagatcagcaacgagctgaaccacatcctgctcgagaacgacatgaagttcaccgtcgtggtgggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcatcttcaccacgaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtgaagacctgcatctggcccaagagccacacgctctggtccaacggggtcctggagagcgagatgatcatccccaagatctacggcgggccgatctcccagcacaactaccggcccggctacttcacccagaccgccgggccctggcacctgggcaagctcgagctggacttcgacctgtgcgagggcaccacggtggtggtcgacgagcactgcgggaaccgcggcccgagcctccggaccaccaccgtgacggggaagatcatccacgagtggtgctgccgctcctgcaccctgccgcccctgcggttccgcggcgaggacgggtgctggtacggcatggagatccggcccgtgaaggagaaggaggagaacctcgtccgcagcatggtgtccgccggcagcggggaggtggacagcttctccctgggcatcctgtgcgtcagcatcatgatcgaggaggtgatgcggtcccgctggagccgcaagatgctcatgaccgggaccctggccgtgttcctgctcctgatcatgggccagctgacgtggaacgacctcatccggctgtgcatcatggtcggggccaacgcgtccgaccgcatgggcatgggcaccacctacctggccctcatggccaccttcaagatgcggccgatgttcgccgtggggctgctgttccgccggctcacgagccgcgaggtgctgctgctcaccatcggcctgtccctggtcgccagcgtggagctccccaactccctggaggagctgggggacggcctcgcgatgggcatcatgatgctgaagctgctcaccgagttccagccccaccagctgtggaccacgctgctcagcctgaccttcgtcaagaccaccctgtccctcgactacgcctggaagacgaccgccatggtgctgagcatcgtgtccctgttccccctctgcctgagcaccacctcccagaagacgacctggctgccggtcctcctggggagcttcggctgcaagcccctgaccatgttcctcatcaccgagaacaagatctgggggcggaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcaccatgaagatcaaggacgaggagcgcgacgacacgctcaccatcctgctgaaggccaccctcctggccgtgtccggggtgtaccccatgagcatccccgcgaccctgttcgtctggtacttctggcagaagaagaagcagcggtccggcgtgctctgggacacgcccagcccgcccgaggtggagcgcgccgtcctggacgacggcatctaccggatcctgcagcgcgggctgctcggccggtcccaggtgggggtgggcgtcttccaggacggggtgttccacaccatgtggcacgtgacccgcggcgccgtcctgatgtaccagggcaagcggctggagcccagctgggcctccgtgaagaaggacctcatcagctacgggggcgggtggcgcttccagggctcctggaacaccggggaggaggtgcaggtcatcgccgtggagcccggcaagaacccgaagaacgtgcagacgacccccggcaccttcaagacccccgagggggaggtcggcgcgatcgccctggacttcaagcccgggacgagcggctccccgatcgtgaaccgggagggcaagatcgtggggctgtacggcaacggggtcgtgaccaccagcggcacctacgtgtccgccatcgcccaggccaaggcgagccaggaggggcccctccccgagatcgaggacgaggtcttcaagaagcgcaacctgacgatcatggacctgcacccgggcagcggcaagacccggcgctacctccccgccatcgtgcgggaggccatcaagcgcaagctgcgcaccctgatcctcgcccccacccgggtggtcgcgtccgagatggccgaggccctgaaggggatgcccatccgctaccagacgaccgccgtcaagagcgagcacaccggccgggagatcgtggacctgatgtgccacgccaccttcacgatgcgcctcctgtccccggtccgggtgcccaactacaacatgatcatcatggacgaggcgcacttcaccgaccccgccagcatcgccgcccgcgggtacatctccacccgggtgggcatgggggaggccgcggccatcttcatgaccgccacgcccccgggcagcgtcgaggccttcccccagtccaacgccgtgatccaggacgaggagcgcgacatccccgagcggagctggaactccggctacgactggatcaccgacttccccgggaagaccgtgtggttcgtcccgagcatcaagtccggcaacgacatcgcgaactgcctgcgcaagaacgggaagcgggtgatccagctcagccgcaagaccttcgacacggagtaccagaagaccaagaacaacgactgggactacgtggtcaccaccgacatctccgagatgggcgccaacttccgggccgaccgcgtgatcgacccccggcgctgcctgaagcccgtgatcctgaaggacgggcccgagcgggtcatcctcgccggcccgatgcccgtgacggtcgcgagcgccgcccagcgccggggccgcatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgggagaagtccgccgccatcgacggggagtaccgcctgcggggcgaggcccgcaagaccttcgtggagctcatgcggcgcggcgacctgcccgtctggctgagctacaaggtggcctccgaggggttccagtacagcgaccggcgctggtgcttcgacggcgagcggaacaaccaggtgctcgaggagaacatggacgtcgagatctggacgaaggagggggagcgcaagaagctgcggccccgctggctggacgcgcggacctactccgacccgctcgccctgcgcgagttcaaggagttcgccgccggccggcgcagcgtgagcggcgacctgatcctcgagatcgggaagctgccccagcacctgaccctccgggcccagaacgcgctggacaacctggtgatgctccacaactccgagcagggcgggaaggcctaccgccacgccatggaggagctgcccgacaccatcgagaccctgatgctcctggccctgatcgcggtcctcacgggcggggtgaccctgttcttcctgagcggcaagggcctcgggaagacctccatcggcctgctgtgcgtgaccgccagctccgccctcctgtggatggccagcgtcgagccccactggatcgccgcgtccatcatcctggagttcttcctcatggtgctgctgatcccggagcccgaccggcagcgcacgccccaggacaaccagctcgcctacgtggtcatcgggctgctgttcatgatcctcaccgtggccgccaacgagatgggcctgctggagaccaccaagaaggacctcgggatcggctacgtggccgcggagaaccaccagcacgccacgatgctggacgtcgacctgcggccggccagcgcctggaccctctacgccgtggcgaccaccgtgatcacgcccatgatgcgccacaccatcgagaacaccaccgccaacatctccctgacggccatcgccaaccaggccgcgatcctgatgggcctcgacaaggggtggcccatcagcaagatggacatcggcgtccccctgctggccctcgggtgctactcccaggtgaacccgctgaccctgaccgccgccgtgctcatgctggtcgcgcactacgccatcatcggccccgggctgcaggccaaggccacccgcgaggcccagaagcggacggcggccggcatcatgaagaaccccaccgtggacggcatcgtggccatcgacctcgaccccgtcgtgtacgacgccaagttcgagaagcagctggggcagatcatgctgctcatcctgtgcaccagccagatcctgctcatgcgcaccacgtgggccctgtgcgagtccatcaccctggcgaccggcccgctcaccacgctgtgggaggggagccccggcaagttctggaacaccaccatcgccgtgtccatggccaacatcttccggggcagctacctggccggggccggcctcgcgttctccctgatgaagtccctcgggggcgggcgccgggggaccggcgcccagggggagacgctcggcgagaagtggaagcgccagctgaaccagctgtccaagagcgagttcaacacctacaagcggagcgggatcatggaggtcgaccgctccgaggccaaggagggcctcaagcgcggggagaccaccaagcacgccgtgagccgcggcacggcgaagctgcggtggttcgtggagcgcaacctggtcaagcccgagggcaaggtgatcgacctggggtgcggccgcggcgggtggtcctactactgcgccgggctcaagaaggtgaccgaggtcaaggggtacaccaagggcgggcccggccacgaggagccgatccccatggccacctacgggtggaacctggtgaagctgcacagcggcaaggacgtgttcttcatgccgcccgagaagtgcgacaccctcctgtgcgacatcggggagtccagcccgaaccccacgatcgaggagggccgcaccctgcgggtcctcaagatggtggagccctggctgaagggcaaccagttctgcatcaagatcctgaacccctacatgccgtccgtggtcgagaccctcgagcagatgcagcgcaagcacgggggcatgctggtgcggaaccccctgagccgcaactccacccacgagatgtactgggtgagctgcgggacgggcaacatcgtctccgccgtgaacatgaccagccggatgctcctgaaccgcttcaccatggcccaccgcaagcccacctacgagcgggacgtggacctgggcgcggggacgcgccacgtcgccgtggagcccgaggtggccaacctcgacatcatcggccagcggatcgagaacatcaagaacgagcacaagtccacctggcactacgacgaggacaacccgtacaagacctgggcctaccacgggagctacgaggtcaagccctccggcagcgcctccagcatggtgaacggggtcgtgcgcctgctgaccaagccctgggacgtgatccccatggtcacgcagatcgcgatgaccgacaccaccccgttcggccagcagcgggtgttcaaggagaaggtggacacgcgcacgccccgggccaagcgcggcaccacccagatcatggaggtcacggccaagtggctctgggggttcctgtcccggaacaagaagccccgcatctgcacccgggaggagttcacccgcaaggtgcggagcaacgccgccatcggcgcggtgttcgtcgacgagaaccagtggaacagcgccaaggaggccgtggaggacgagcgcttctgggacctggtgcaccgggagcgcgagctccacaagcaggggaagtgcgcgacctgcgtctacaacatgatgggcaagcgggagaagaagctgggggagttcggcaaggcgaagggctcccgcgccatctggtacatgtggctgggggcccggttcctcgagttcgaggccctgggcttcatgaacgaggaccactggttcagccgcgagaactccctgagcggggtggagggcgaggggctccacaagctgggctacatcctgcgggacatctccaagatcccgggcgggaacatgtacgccgacgacacggcgggctgggacacccgcatcaccgaggacgacctccagaacgaggccaagatcaccgacatcatggagcccgagcacgccctgctggccacgagcatcttcaagctcacctaccagaacaaggtggtccgcgtgcagcggcccgccaagaacgggaccgtgatggacgtcatctcccgccgggaccagcgcggcagcggccaggtggggacctacggcctgaacacgttcaccaacatggaggtgcagctgatccggcagatggagtccgaggggatcttcctccccagcgagctggagaccccgaacctggcggagcgcgtcctcgactggctggagaagcacggcgccgagcggctgaagcgcatggccatctccggggacgactgcgtggtgaagcccatcgacgaccggttcgccaccgccctcacggcgctgaacgacatgggcaaggtccgcaaggacatcccccagtgggagcccagcaagggctggaacgactggcagcaggtcccgttctgctcccaccacttccaccagctgatcatgaaggacgggcgggagatcgtggtcccctgccgcaaccaggacgagctcgtgggccgggcccgcgtgagccagggggccggctggtccctgcgggagaccgcctgcctgggcaagagctacgcccagatgtggcagctcatgtacttccaccgccgggacctgcgcctggcggccaacgccatctgctccgccgtccccgtggactgggtgcccaccagccggaccacctggagcatccacgcgcaccaccagtggatgacgaccgaggacatgctctccgtctggaaccgcgtgtggatcgaggagaacccgtggatggaggacaagacccacgtgagctcctgggaggaggtcccctacctgggcaagcgcgaggaccagtggtgcggcagcctgatcgggctcaccgcccgggccacgtgggccaccaacatccaggtggccatcaaccaggtgcgccggctgatcggcaacgagaactacctggactacatgacctccatgaagcgcttcaagaacgagagcgaccccgagggggcgctctggtga

SEQ ID NO: 8240 - RNA, 9879 nt, synthetic construct
  misc_feature 1..9879: note = derived and/or modified CDS sequence (opt1) from DENV-1__FJ639802__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgccggggtgaacatgtgcaccctgatcgccatggacctgggcgagctctgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtaccgcttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcaccgtcgtggtgggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcatcttcaccacgaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtgaagacctgcatctggcccaagagccacacgctctggtccaacggggtcctggagagcgagatgatcatccccaagatctacggcgggccgatctcccagcacaactaccggcccggctacttcacccagaccgccgggccctggcacctgggcaagctcgagctggacttcgacctgtgcgagggcaccacggtggtggtcgacgagcactgcgggaaccgcggcccgagcctccggaccaccaccgtgacggggaagatcatccacgagtggtgctgccgctcctgcaccctgccgcccctgcggttccgcggcgaggacgggtgctggtacggcatggagatccggcccgtgaaggagaaggaggagaacctcgtccgcagcatggtgtccgccggcagcggggaggtggacagcttctccctgggcatcctgtgcgtcagcatcatgatcgaggaggtgatgcggtcccgctggagccgcaagatgctcatgaccgggaccctggccgtgttcctgctcctgatcatgggccagctgacgtggaacgacctcatccggctgtgcatcatggtcggggccaacgcgtccgaccgcatgggcatgggcaccacctacctggccctcatggccaccttcaagatgcggccgatgttcgccgtggggctgctgttccgccggctcacgagccgcgaggtgctgctgctcaccatcggcctgtccctggtcgccagcgtggagctccccaactccctggaggagctgggggacggcctcgcgatgggcatcatgatgctgaagctgctcaccgagttccagccccaccagctgtggaccacgctgctcagcctgaccttcgtcaagaccaccctgtccctcgactacgcctggaagacgaccgccatggtgctgagcatcgtgtccctgttccccctctgcctgagcaccacctcccagaagacgacctggctgccggtcctcctggggagcttcggctgcaagcccctgaccatgttcctcatcaccgagaacaagatctgggggcggaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcaccatgaagatcaaggacgaggagcgcgacgacacgctcaccatcctgctgaaggccaccctcctggccgtgtccggggtgtaccccatgagcatccccgcgaccctgttcgtctggtacttctggcagaagaagaagcagcggtccggcgtgctctgggacacgcccagcccgcccgaggtggagcgcgccgtcctggacgacggcatctaccggatcctgcagcgcgggctgctcggccggtcccaggtgggggtgggcgtcttccaggacggggtgttccacaccatgtggcacgtgacccgcggcgccgtcctgatgtaccagggcaagcggctggagcccagctgggcctccgtgaagaaggacctcatcagctacgggggcgggtggcgcttccagggctcctggaacaccggggaggaggtgcaggtcatcgccgtggagcccggcaagaacccgaagaacgtgcagacgacccccggcaccttcaagacccccgagggggaggtcggcgcgatcgccctggacttcaagcccgggacgagcggctccccgatcgtgaaccgggagggcaagatcgtggggctgtacggcaacggggtcgtgaccaccagcggcacctacgtgtccgccatcgcccaggccaaggcgagccaggaggggcccctccccgagatcgaggacgaggtcttcaagaagcgcaacctgacgatcatggacctgcacccgggcagcggcaagacccggcgctacctccccgccatcgtgcgggaggccatcaagcgcaagctgcgcaccctgatcctcgcccccacccgggtggtcgcgtccgagatggccgaggccctgaaggggatgcccatccgctaccagacgaccgccgtcaagagcgagcacaccggccgggagatcgtggacctgatgtgccacgccaccttcacgatgcgcctcctgtccccggtccgggtgcccaactacaacatgatcatcatggacgaggcgcacttcaccgaccccgccagcatcgccgcccgcgggtacatctccacccgggtgggcatgggggaggccgcggccatcttcatgaccgccacgcccccgggcagcgtcgaggccttcccccagtccaacgccgtgatccaggacgaggagcgcgacatccccgagcggagctggaactccggctacgactggatcaccgacttccccgggaagaccgtgtggttcgtcccgagcatcaagtccggcaacgacatcgcgaactgcctgcgcaagaacgggaagcgggtgatccagctcagccgcaagaccttcgacacggagtaccagaagaccaagaacaacgactgggactacgtggtcaccaccgacatctccgagatgggcgccaacttccgggccgaccgcgtgatcgacccccggcgctgcctgaagcccgtgatcctgaaggacgggcccgagcgggtcatcctcgccggcccgatgcccgtgacggtcgcgagcgccgcccagcgccggggccgcatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgggagaagtccgccgccatcgacggggagtaccgcctgcggggcgaggcccgcaagaccttcgtggagctcatgcggcgcggcgacctgcccgtctggctgagctacaaggtggcctccgaggggttccagtacagcgaccggcgctggtgcttcgacggcgagcggaacaaccaggtgctcgaggagaacatggacgtcgagatctggacgaaggagggggagcgcaagaagctgcggccccgctggctggacgcgcggacctactccgacccgctcgccctgcgcgagttcaaggagttcgccgccggccggcgcagcgtgagcggcgacctgatcctcgagatcgggaagctgccccagcacctgaccctccgggcccagaacgcgctggacaacctggtgatgctccacaactccgagcagggcgggaaggcctaccgccacgccatggaggagctgcccgacaccatcgagaccctgatgctcctggccctgatcgcggtcctcacgggcggggtgaccctgttcttcctgagcggcaagggcctcgggaagacctccatcggcctgctgtgcgtgaccgccagctccgccctcctgtggatggccagcgtcgagccccactggatcgccgcgtccatcatcctggagttcttcctcatggtgctgctgatcccggagcccgaccggcagcgcacgccccaggacaaccagctcgcctacgtggtcatcgggctgctgttcatgatcctcaccgtggccgccaacgagatgggcctgctggagaccaccaagaaggacctcgggatcggctacgtggccgcggagaaccaccagcacgccacgatgctggacgtcgacctgcggccggccagcgcctggaccctctacgccgtggcgaccaccgtgatcacgcccatgatgcgccacaccatcgagaacaccaccgccaacatctccctgacggccatcgccaaccaggccgcgatcctgatgggcctcgacaaggggtggcccatcagcaagatggacatcggcgtccccctgctggccctcgggtgctactcccaggtgaacccgctgaccctgaccgccgccgtgctcatgctggtcgcgcactacgccatcatcggccccgggctgcaggccaaggccacccgcgaggcccagaagcggacggcggccggcatcatgaagaaccccaccgtggacggcatcgtggccatcgacctcgaccccgtcgtgtacgacgccaagttcgagaagcagctggggcagatcatgctgctcatcctgtgcaccagccagatcctgctcatgcgcaccacgtgggccctgtgcgagtccatcaccctggcgaccggcccgctcaccacgctgtgggaggggagccccggcaagttctggaacaccaccatcgccgtgtccatggccaacatcttccggggcagctacctggccggggccggcctcgcgttctccctgatgaagtccctcgggggcgggcgccgggggaccggcgcccagggggagacgctcggcgagaagtggaagcgccagctgaaccagctgtccaagagcgagttcaacacctacaagcggagcgggatcatggaggtcgaccgctccgaggccaaggagggcctcaagcgcggggagaccaccaagcacgccgtgagccgcggcacggcgaagctgcggtggttcgtggagcgcaacctggtcaagcccgagggcaaggtgatcgacctggggtgcggccgcggcgggtggtcctactactgcgccgggctcaagaaggtgaccgaggtcaaggggtacaccaagggcgggcccggccacgaggagccgatccccatggccacctacgggtggaacctggtgaagctgcacagcggcaaggacgtgttcttcatgccgcccgagaagtgcgacaccctcctgtgcgacatcggggagtccagcccgaaccccacgatcgaggagggccgcaccctgcgggtcctcaagatggtggagccctggctgaagggcaaccagttctgcatcaagatcctgaacccctacatgccgtccgtggtcgagaccctcgagcagatgcagcgcaagcacgggggcatgctggtgcggaaccccctgagccgcaactccacccacgagatgtactgggtgagctgcgggacgggcaacatcgtctccgccgtgaacatgaccagccggatgctcctgaaccgcttcaccatggcccaccgcaagcccacctacgagcgggacgtggacctgggcgcggggacgcgccacgtcgccgtggagcccgaggtggccaacctcgacatcatcggccagcggatcgagaacatcaagaacgagcacaagtccacctggcactacgacgaggacaacccgtacaagacctgggcctaccacgggagctacgaggtcaagccctccggcagcgcctccagcatggtgaacggggtcgtgcgcctgctgaccaagccctgggacgtgatccccatggtcacgcagatcgcgatgaccgacaccaccccgttcggccagcagcgggtgttcaaggagaaggtggacacgcgcacgccccgggccaagcgcggcaccacccagatcatggaggtcacggccaagtggctctgggggttcctgtcccggaacaagaagccccgcatctgcacccgggaggagttcacccgcaaggtgcggagcaacgccgccatcggcgcggtgttcgtcgacgagaaccagtggaacagcgccaaggaggccgtggaggacgagcgcttctgggacctggtgcaccgggagcgcgagctccacaagcaggggaagtgcgcgacctgcgtctacaacatgatgggcaagcgggagaagaagctgggggagttcggcaaggcgaagggctcccgcgccatctggtacatgtggctgggggcccggttcctcgagttcgaggccctgggcttcatgaacgaggaccactggttcagccgcgagaactccctgagcggggtggagggcgaggggctccacaagctgggctacatcctgcgggacatctccaagatcccgggcgggaacatgtacgccgacgacacggcgggctgggacacccgcatcaccgaggacgacctccagaacgaggccaagatcaccgacatcatggagcccgagcacgccctgctggccacgagcatcttcaagctcacctaccagaacaaggtggtccgcgtgcagcggcccgccaagaacgggaccgtgatggacgtcatctcccgccgggaccagcgcggcagcggccaggtggggacctacggcctgaacacgttcaccaacatggaggtgcagctgatccggcagatggagtccgaggggatcttcctccccagcgagctggagaccccgaacctggcggagcgcgtcctcgactggctggagaagcacggcgccgagcggctgaagcgcatggccatctccggggacgactgcgtggtgaagcccatcgacgaccggttcgccaccgccctcacggcgctgaacgacatgggcaaggtccgcaaggacatcccccagtgggagcccagcaagggctggaacgactggcagcaggtcccgttctgctcccaccacttccaccagctgatcatgaaggacgggcgggagatcgtggtcccctgccgcaaccaggacgagctcgtgggccgggcccgcgtgagccagggggccggctggtccctgcgggagaccgcctgcctgggcaagagctacgcccagatgtggcagctcatgtacttccaccgccgggacctgcgcctggcggccaacgccatctgctccgccgtccccgtggactgggtgcccaccagccggaccacctggagcatccacgcgcaccaccagtggatgacgaccgaggacatgctctccgtctggaaccgcgtgtggatcgaggagaacccgtggatggaggacaagacccacgtgagctcctgggaggaggtcccctacctgggcaagcgcgaggaccagtggtgcggcagcctgatcgggctcaccgcccgggccacgtgggccaccaacatccaggtggccatcaaccaggtgcgccggctgatcggcaacgagaactacctggactacatgacctccatgaagcgcttcaagaacgagagcgaccccgagggggcgctctggtga

SEQ ID NO: 8241 - RNA, 9879 nt, synthetic construct
  misc_feature 1..9879: note = derived and/or modified CDS sequence (opt1) from DENV-1__JN819410__SS-prME
  source 1..9879: mol_type = other RNA
agcgtgaccatgctgctcatgctgctgcccaccgccctcgccttccacctgaccacccggggcggggagccccacatgatcgtcagcaagcaggagcggggcaagagcctgctgttcaagacctccgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccctggtggaccggggctgggggaacggctgcggcctcttcggcaaggggaacctgctgacgtgcgccaagttcaagtgcgtgaccaagctcgagggcaagatcgtccagtacgagaacctgaagtacagcgtgatcgtgaccgtccacaccggcgaccagcaccaggtggggaacgagacgaccgagcacggcaccatcgcgaccatcacgccccaggcccccacgtccgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggcagccaggagggcgccatgcacaccgccctcaccggggccacggagatccagacctccggcaccaccacgatcttcgccgggcacctgaagtgccgcctgaagatggacaagctcaccctgaagggcatgagctacgtcatgtgcaccgggtccttcaagctggagaaggaggtggcggagacccagcacggcacggtgctggtccaggtgaagtacgagggcaccgacgccccctgcaagatccccttcagcacccaggacgagaagggggtgacccagaacggccggctcatcacggccaacccgatcgtcaccgacaaggagaagcccgtgaacatcgagaccgagccgcccttcggggagtcctacatcgtggtcggcgccggcgagaaggcgctgaagctgagctggttcaagcgcgggtccagcatcggcaagatgttcgaggccaccgcccgcggggcccgccgcatggccatcctcggcgacacggcgtgggacttcgggtccatcggcggcgtgttcaccagcgtggggaagctggtccaccaggtgttcggcaccgcctacggggtgctgttctccggcgtcagctggaccatgaagatcgggatcggcatcctcctgacgtggctgggcctcaactcccggagcacctccctgagcatgacctgcatcgccgtggggatggtgaccctgtacctcggcgtcatggtgcaggccgactccgggtgcgtgatcaactggaagggccgcgagctgaagtgcgggagcggcatcttcgtcacgaacgaggtgcacacctggaccgagcagtacaagttccaggccgactccccgaagcggctgagcgcggccatcggcaaggcctgggaggagggggtgtgcggcatccgcagcgccacccggctcgagaacatcatgtggaagcagatctccaacgagctgaaccacatcctgctcgagaacgacatgaagttcaccgtcgtggtgggggacgccaacggcatcctggcgcaggggaagaagatgatccgcccccagcccatggagcacaagtacagctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctccgcgacagctacacccagatgtgcgaccaccggctgatgtccgcggccatcaaggacagcaaggccgtgcacgccgacatgggctactggatcgagtccgagaagaacgagacctggaagctggcccgcgcgagcttcatcgaggtcaagacctgcacgtggcccaagtcccacaccctctggagcaacggggtgctggagtccgagatgatcatccccaagatctacggcgggccgatcagccagcacaactaccggcccggctacttcacccagaccgccgggccctggcacctgggcaagctcgagctggacttcgacctgtgcgagggcacgaccgtggtcgtggacgagcactgcgggaaccgcggcccgtccctccggaccaccacggtgaccgggaagatcatccacgagtggtgctgccgcagctgcaccctgccgcccctgcggttccgcggcgaggacgggtgctggtacggcatggagatccggcccgtcaaggagaaggaggagaacctcgtgcgctccatggtgagcgccggctccggggaggtcgacagcttcagcctgggcatcctgtgcgtgtccatcatgatcgaggaggtgatgcggagccgctggtcccgcaagatgctcatgaccgggacgctggccgtcttcctgctcctgatcatgggccagctgacctggaacgacctcatccggctgtgcatcatggtgggggccaacgcgagcgaccgcatgggcatgggcaccacctacctggccctcatggccacgttcaagatgcggccgatgttcgccgtggggctgctgttccgccggctcacctcccgcgaggtcctgctgctcaccatcggcctgagcctggtggcctccgtcgagctccccaacagcctggaggagctgggggacggcctcgcgatgggcatcatgatgctgaagctgctcaccgagttccagccccaccagctgtggacgaccctgctctccctgaccttcatcaagaccacgctgagcctcgactacgcctggaagaccaccgccatggtgctgtccatcgtgagcctgttccccctctgcctgtccaccacgagccagaagaccacctggctgccggtcctcctggggtccttcggctgcaagcccctgaccatgttcctcatcaccgagaacaagatctgggggcgcaagagctggcccctgaacgagggcatcatggccatcgggatcgtgtccatcctgctcagctccctgctgaagaacgacgtgcccctcgcgggcccgctgatcgccggcgggatgctgatcgcctgctacgtcatcagcggcagctccgccgacctcagcctggagaaggccgcggaggtgtcctgggagcaggaggccgagcacagcggggcctcccacaacatcctggtggaggtccaggacgacggcacgatgaagatcaaggacgaggagcgcgacgacaccctcaccatcctgctgaaggccaccctcctggccgtgagcggggtgtaccccatgtccatccccgcgacgctgttcgtctggtacttctggcagaagaagaagcagcggagcggcgtgctctgggacaccccctccccgcccgaggtggagcgcgccgtcctggacgacggcatctaccggatcctgcagcgcgggctgctcggccggagccaggtgggggtgggcgtcttccaggacggggtgttccacaccatgtggcacgtgacccgcggcgccgtcctgatgtaccagggcaagcggctggagccctcctgggccagcgtgaagaaggacctcatctcctacgggggcgggtggcgcttccagggcagctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggacctccggcagcccgatcgtgaaccgggagggcaagatcgtggggctgtacggcaacggggtcgtgaccacctccggcacgtacgtgagcgccatcgcccaggccaaggcgtcccaggaggggcccctccccgagatcgaggacgaggtcttcaagaagcgcaacctgaccatcatggacctgcacccgggcagcggcaagacccggcgctacctccccgccatcgtgcgggaggccatcaagcgcaagctgcgcaccctgatcctcgcccccacgcgggtggtcgcgagcgagatggccgaggccctgaaggggatgcccatccgctaccagaccaccgccgtgaagtccgagcacaccggccgggagatcgtggacctgatgtgccacgccacgttcaccatgcgcctcctgagcccggtccgggtgcccaactacaacatgatcatcatggacgaggcgcacttcaccgaccccgcctccatcgccgcccgcgggtacatcagcacccgggtgggcatgggggaggccgcggccatcttcatgacggccacgccgcccggctccgtcgaggccttcccccagagcaacgccgtgatccaggacgaggagcgcgacatccccgagcggtcctggaacagcggctacgactggatcaccgacttccccgggaagaccgtgtggttcgtcccctccatcaagagcggcaacgacatcgcgaactgcctgcgcaagaacgggaagcgggtgatccagctctcccgcaagacgttcgacaccgagtaccagaagaccaagaacaacgactgggactacgtggtcaccacggacatcagcgagatgggcgccaacttccgggccgaccgcgtgatcgacccccggcgctgcctgaagcccgtgatcctgaaggacgggcccgagcgggtcatcctcgccggcccgatgcccgtgaccgtcgcgtccgccgcccagcgccggggccgcatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgggagaagtccgccgccatcgacggggagtaccgcctgcggggcgaggcccgcaagacgttcgtggagctcatgcggcgcggcgacctgcccgtctggctgtcctacaaggtggccagcgaggggttccagtactccgaccggcgctggtgcttcgacggcgagcggaacaaccaggtgctcgaggagaacatggacgtcgagatctggaccaaggagggggagcgcaagaagctgcggccccgctggctggacgcgcggacctacagcgacccgctcgccctgcgcgagttcaaggagttcgccgccggccggcgctccgtgagcggcgacctgatcctcgagatcgggaagctgccccagcacctgaccctccgggcccagaacgcgctggacaacctggtgatgctccacaacagcgagcagggcgggaaggcctaccgccacgccatggaggagctgcccgacaccatcgagacgctgatgctcctggccctgatcgcggtcctcaccggcggggtgaccctgttcttcctgtccggcaagggcctcgggaagaccagcatcggcctgctgtgcgtgacggcctccagcgccctcctgtggatggcctccgtcgagccccactggatcgccgcgagcatcatcctggagttcttcctcatggtgctgctgatcccggagcccgaccggcagcgcacgccccaggacaaccagctcgcctacgtggtcatcgggctgctgttcatgatcctcaccgtggccgccaacgagatgggcctgctggagaccacgaagaaggacctcgggatcggctacgtggccgcggagaaccaccagcacgccaccatgctggacgtcgacctgcacccggcctccgcctggaccctctacgccgtggcgaccacggtgatcacccccatgatgcggcacaccatcgagaacaccacggccaacatcagcctgaccgccatcgccaaccaggccgcgatcctgatgggcctcgacaaggggtggcccatctccaagatggacatcggcgtccccctgctggccctcgggtgctacagccaggtgaacccgctgaccctgaccgccgccgtgctcatgctggtcgcgcactacgccatcatcggccccgggctgcaggccaaggccacgcgcgaggcccagaagcgcaccgcggccggcatcatgaagaaccccaccgtggacggcatcgtggccatcgacctcgaccccgtcgtgtacgacgccaagttcgagaagcagctggggcagatcatgctgctcatcctgtgcacctcccagatcctgctcatgcggacgacctgggccctgtgcgagagcatcaccctggcgaccggcccgctcacgaccctgtgggaggggtcccccggcaagttctggaacaccaccatcgccgtgagcatggccaacatcttccgcggctcctacctggccggggccggcctcgcgttcagcctgatgaagtccctcgggggcgggcggcgcgggacgggcgcccagggggagaccctcggcgagaagtggaagcggcagctgaaccagctgagcaagtccgagttcaacacctacaagcgcagcgggatcatggaggtcgaccggagcgaggccaaggagggcctcaagcgcggggagaccacgaagcacgccgtgtcccggggcaccgcgaagctgcgctggttcgtggagcggaacctggtcaagcccgagggcaaggtgatcgacctggggtgcggccgcgggggctggagctactactgcgccgggctcaagaaggtgaccgaggtcaagggctacaccaagggcgggcccggccacgaggagccgatccccatggccacctacgggtggaacctggtgaagctgcactccggcaaggacgtgttcttcatgccgcccgagaagtgcgacacgctcctgtgcgacatcggggagagctccccgaaccccaccatcgaggagggccggaccctgcgcgtcctcaagatggtggagccctggctgcggggcaaccagttctgcatcaagatcctgaacccctacatgccgagcgtggtcgagaccctcgagcagatgcagcgcaagcacgggggcatgctggtgcggaaccccctgtcccgcaacagcacgcacgagatgtactgggtgtcctgcgggaccggcaacatcgtcagcgccgtgaacatgacctcccggatgctcctgaaccgcttcaccatggcccaccgcaagcccacgtacgagcgggacgtggacctgggcgcggggacccgccacgtcgccgtggagcccgaggtggccaacctcgacatcatcggccagcggatcgagaacatcaagaacgagcacaagagcacctggcactacgacgaggacaacccgtacaagacctgggcctaccacgggtcctacgaggtcaagcccagcggctccgccagctccatggtgaacggggtcgtgcgcctgctgacgaagccctgggacgtgatccccatggtcacccagatcgcgatgaccgacaccacgccgttcggccagcagcgggtgttcaaggagaaggtggacacccgcacgccccgggccaagcgcggcaccacgcagatcatggaggtcaccgccaagtggctctgggggttcctgagccggaacaagaagccccgcatctgcacccgggaggagttcacccgcaaggtgcggtccaacgccgccatcggcgcggtgttcgtcgacgagaaccagtggaacagcgccaaggaggccgtggaggacgagcgcttctgggacctggtgcaccgggagcgcgagctccacaagcaggggaagtgcgccacgtgcgtctacaacatgatgggcaagcgggagaagaagctgggggagttcggcaaggcgaagggcagccgcgccatctggtacatgtggctgggggcccggttcctcgagttcgaggccctgggcttcatgaacgaggaccactggttctcccgcgagaacagcctgtccggggtggagggcgaggggctccacaagctgggctacatcctgcgggacatcagcaagatcccgggcgggaacatgtacgccgacgacaccgcgggctgggacacccgcatcaccgaggacgacctccagaacgaggccaagatcacggacatcatggagcccgagcacgccctgctggccacctccatcttcaagctcacctaccagaacaaggtggtccgcgtgcagcggcccgccaagaacgggaccgtgatggacgtcatcagccgccgggaccagcgcggctccggccaggtggggacgtacggcctgaacaccttcaccaacatggaggtgcagctgatccggcagatggagagcgaggggatcttcctcccctccgagctggagaccccgaacctggcggagcgcgccctcgactggctggagaagcacggcgccgagcggctgaagcgcatggccatcagcggggacgactgcgtcgtgaagcccatcgacgaccggttcgccacggcgctcaccgccctgaacgacatgggcaaggtgcgcaaggacatcccccagtgggagccctccaagggctggaacgactggcagcaggtcccgttctgcagccaccacttccaccagctgatcatgaaggacgggcgggagatcgtggtgccctgccgcaaccaggacgagctcgtcggccgggcccgcgtgtcccagggggccggctggagcctgcgggagaccgcctgcctggggaagtcctacgcgcagatgtggcagctcatgtacttccaccgccgggacctgcgcctggccgccaacgccatctgcagcgcggtgcccgtcgactgggtgcccacctcccggaccacgtggagcatccacgcccaccaccagtggatgaccaccgaggacatgctcagcgtgtggaaccgcgtctggatcgaggagaacccgtggatggaggacaagacccacgtgtccagctgggaggaggtgccctacctgggcaagcgcgaggaccagtggtgcggctccctgatcgggctcacggcccgggccacctgggccaccaacatccaggtcgcgatcaaccaggtgcgccggctgatcggcaacgagaactacctggactacatgaccagcatgaagcgcttcaagaacgagtccgaccccgagggggccctctggtga

SEQ ID NO: 8242 - RNA, 9879 nt, synthetic construct
  misc_feature 1..9879: note = derived and/or modified CDS sequence (opt1) from DENV-1__FJ639806__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgccggggtgaacatgtgcaccctgatcgccatggacctgggcgagctctgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggccgggcctgggaggagggggtgtgcggcatccgctccgccacccggctcgagaacatcatgtggaagcagatcagcaacgagctgaaccacatcctgctcgagaacgacatgaagttcaccgtcgtggtgggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcatcttcaccacgaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtgaagacctgcatctggcccaagagccacacgctctggtccaacggggtcctggagagcgagatgatcatccccaagatctacggcgggccgatctcccagcacaactaccggcccggctacttcacccagaccgccgggccctggcacctgggcaagctcgagctggacttcgacctgtgcgagggcaccacggtggtggtcgacgagcactgcgggaaccgcggcccgagcctccggaccaccaccgtgacggggaagatcatccacgagtggtgctgccgctcctgcaccctgccgcccctgcggttccgcggcgaggacgggtgctggtacggcatggagatccggcccgtgaaggagaaggaggagaacctcgtccgcagcatggtgtccgccggcagcggggaggtggacagcttctccctgggcatcctgtgcgtcagcatcatgatcgaggaggtgatgcggtcccgctggagccgcaagatgctcatgaccgggaccctggccgtgttcctgctcctgatcatgggccagctgacgtggaacgacctcatccggctgtgcatcatggtcggggccaacgcgtccgaccgcatgggcatgggcaccacctacctggccctcatggccaccttcaagatgcggccgatgttcgccgtggggctgctgttccgccggctcacgagccgcgaggtgctgctgctcaccatcggcctgtccctggtcgccagcgtggagctccccaactccctggaggagctgggggacggcctcgcgatgggcatcatgatgctgaagctgctcaccgagttccagccccaccagctgtggaccacgctgctcagcctgaccttcgtcaagaccaccctgtccctcgactacgcctggaagacgaccgccatggtgctgagcatcgtgtccctgttccccctctgcctgagcaccacctcccagaagacgacctggctgccggtcctcctggggagcttcggctgcaagcccctgaccatgttcctcatcaccgagaacaagatctgggggcggaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcaccatgaagatcaaggacgaggagcgcgacgacacgctcaccatcctgctgaaggccaccctcctggccgtgtccggggtgtaccccatgagcatccccgcgaccctgttcgtctggtacttctggcagaagaagaagcagcggtccggcgtgctctgggacacgcccagcccgcccgaggtggagcgcgccgtcctggacgacggcatctaccggatcctgcagcgcgggctgctcggccggtcccaggtgggggtgggcgtcttccaggacggggtgttccacaccatgtggcacgtgacccgcggcgccgtcctgatgtaccagggcaagcggctggagcccagctgggcctccgtgaagaaggacctcatcagctacgggggcgggtggcgcttccagggctcctggaacaccggggaggaggtgcaggtcatcgccgtggagcccggcaagaacccgaagaacgtgcagacgacccccggcaccttcaagacccccgagggggaggtcggcgcgatcgccctggacttcaagcccgggacgagcggctccccgatcgtgaaccgggagggcaagatcgtggggctgtacggcaacggggtcgtgaccaccagcggcacctacgtgtccgccatcgcccaggccaaggcgagccaggaggggcccctccccgagatcgaggacgaggtcttcaagaagcgcaacctgacgatcatggacctgcacccgggcagcggcaagacccggcgctacctccccgccatcgtgcgggaggccatcaagcgcaagctgcgcaccctgatcctcgcccccacccgggtggtcgcgtccgagatggccgaggccctgaaggggatgcccatccgctaccagacgaccgccgtcaagagcgagcacaccggccgggagatcgtggacctgatgtgccacgccaccttcacgatgcgcctcctgtccccggtccgggtgcccaactacaacatgatcatcatggacgaggcgcacttcaccgaccccgccagcatcgccgcccgcgggtacatctccacccgggtgggcatgggggaggccgcggccatcttcatgaccgccacgcccccgggcagcgtcgaggccttcccccagtccaacgccgtgatccaggacgaggagcgcgacatccccgagcggagctggaactccggctacgactggatcaccgacttccccgggaagaccgtgtggttcgtcccgagcatcaagtccggcaacgacatcgcgaactgcctgcgcaagaacgggaagcgggtgatccagctcagccgcaagaccttcgacacggagtaccagaagaccaagaacaacgactgggactacgtggtcaccaccgacatctccgagatgggcgccaacttccgggccgaccgcgtgatcgacccccggcgctgcctgaagcccgtgatcctgaaggacgggcccgagcgggtcatcctcgccggcccgatgcccgtgacggtcgcgagcgccgcccagcgccggggccgcatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgggagaagtccgccgccatcgacggggagtaccgcctgcggggcgaggcccgcaagaccttcgtggagctcatgcggcgcggcgacctgcccgtctggctgagctacaaggtggcctccgaggggttccagtacagcgaccggcgctggtgcttcgacggcgagcggaacaaccaggtgctcgaggagaacatggacgtcgagatctggacgaaggagggggagcgcaagaagctgcggccccgctggctggacgcgcggacctactccgacccgctcgccctgcgcgagttcaaggagttcgccgccggccggcgcagcgtgagcggcgacctgatcctcgagatcgggaagctgccccagcacctgaccctccgggcccagaacgcgctggacaacctggtgatgctccacaactccgagcagggcgggaaggcctaccgccacgccatggaggagctgcccgacaccatcgagaccctgatgctcctggccctgatcgcggtcctcacgggcggggtgaccctgttcttcctgagcggcaagggcctcgggaagacctccatcggcctgctgtgcgtgaccgccagctccgccctcctgtggatggccagcgtcgagccccactggatcgccgcgtccatcatcctggagttcttcctcatggtgctgctgatcccggagcccgaccggcagcgcacgccccaggacaaccagctcgcctacgtggtcatcgggctgctgttcatgatcctcaccgtggccgccaacgagatgggcctgctggagaccaccaagaaggacctcgggatcggctacgtggccgcggagaaccaccagcacgccacgatgctggacgtcgacctgcggccggccagcgcctggaccctctacgccgtggcgaccaccgtgatcacgcccatgatgcgccacaccatcgagaacaccaccgccaacatctccctgacggccatcgccaaccaggccgcgatcctgatgggcctcgacaaggggtggcccatcagcaagatggacatcggcgtccccctgctggccctcgggtgctactcccaggtgaacccgctgaccctgaccgccgccgtgctcatgctggtcgcgcactacgccatcatcggccccgggctgcaggccaaggccacccgcgaggcccagaagcggacggcggccggcatcatgaagaaccccaccgtggacggcatcgtggccatcgacctcgaccccgtcgtgtacgacgccaagttcgagaagcagctggggcagatcatgctgctcatcctgtgcaccagccagatcctgctcatgcgcaccacgtgggccctgtgcgagtccatcaccctggcgaccggcccgctcaccacgctgtgggaggggagccccggcaagttctggaacaccaccatcgccgtgtccatggccaacatcttccggggcagctacctggccggggccggcctcgcgttctccctgatgaagtccctcgggggcgggcgccgggggaccggcgcccagggggagacgctcggcgagaagtggaagcgccagctgaaccagctgtccaagagcgagttcaacacctacaagcggagcgggatcatggaggtcgaccgctccgaggccaaggagggcctcaagcgcggggagaccaccaagcacgccgtgagccgcggcacggcgaagctgcggtggttcgtggagcgcaacctggtcaagcccgagggcaaggtgatcgacctggggtgcggccgcggcgggtggtcctactactgcgccgggctcaagaaggtgaccgaggtcaaggggtacaccaagggcgggcccggccacgaggagccgatccccatggccacctacgggtggaacctggtgaagctgcacagcggcaaggacgtgttcttcatgccgcccgagaagtgcgacaccctcctgtgcgacatcggggagtccagcccgaaccccacgatcgaggagggccgcaccctgcgggtcctcaagatggtggagccctggctgaagggcaaccagttctgcatcaagatcctgaacccctacatgccgtccgtggtcgagaccctcgagcagatgcagcgcaagcacgggggcatgctggtgcggaaccccctgagccgcaactccacccacgagatgtactgggtgagctgcgggacgggcaacatcgtctccgccgtgaacatgaccagccggatgctcctgaaccgcttcaccatggcccaccgcaagcccacctacgagcgggacgtggacctgggcgcggggacgcgccacgtcgccgtggagcccgaggtggccaacctcgacatcatcggccagcggatcgagaacatcaagaacgagcacaagtccacctggcactacgacgaggacaacccgtacaagacctgggcctaccacgggagctacgaggtcaagccctccggcagcgcctccagcatggtgaacggggtcgtgcgcctgctgaccaagccctgggacgtgatccccatggtcacgcagatcgcgatgaccgacaccaccccgttcggccagcagcgggtgttcaaggagaaggtggacacgcgcacgccccgggccaagcgcggcaccacccagatcatggaggtcacggccaagtggctctgggggttcctgtcccggaacaagaagccccgcatctgcacccgggaggagttcacccgcaaggtgcggagcaacgccgccatcggcgcggtgttcgtcgacgagaaccagtggaacagcgccaaggaggccgtggaggacgagcgcttctgggacctggtgcaccgggagcgcgagctccacaagcaggggaagtgcgcgacctgcgtctacaacatgatgggcaagcgggagaagaagctgggggagttcggcaaggcgaagggctcccgcgccatctggtacatgtggctgggggcccggttcctcgagttcgaggccctgggcttcatgaacgaggaccactggttcagccgcgagaactccctgagcggggtggagggcgaggggctccacaagctgggctacatcctgcgggacatctccaagatcccgggcgggaacatgtacgccgacgacacggcgggctgggacacccgcatcaccgaggacgacctccagaacgaggccaagatcaccgacatcatggagcccgagcacgccctgctggccacgagcatcttcaagctcacctaccagaacaaggtggtccgcgtgcagcggcccgccaagaacgggaccgtgatggacgtcatctcccgccgggaccagcgcggcagcggccaggtggggacctacggcctgaacacgttcaccaacatggaggtgcagctgatccggcagatggagtccgaggggatcttcctccccagcgagctggagaccccgaacctggcggagcgcgtcctcgactggctgaagaagcacggcgccgagcggctgaagcgcatggccatctccggggacgactgcgtggtgaagcccatcgacgaccggttcgccaccgccctcacggcgctgaacgacatgggcaaggtccgcaaggacatcccccagtgggagcccagcaagggctggaacgactggcagcaggtcccgttctgctcccaccacttccaccagctgatcatgaaggacgggcgggagatcgtggtcccctgccgcaaccaggacgagctcgtgggccgggcccgcgtgagccagggggccggctggtccctgcgggagaccgcctgcctgggcaagagctacgcccagatgtggcagctcatgtacttccaccgccgggacctgcgcctggcggccaacgccatctgctccgccgtccccgtggactgggtgcccaccagccggaccacctggagcatccacgcgcaccaccagtggatgacgaccgaggacatgctctccgtctggaaccgcgtgtggatcgaggagaacccgtggatggaggacaagacccacgtgagctcctgggaggaggtcccctacctgggcaagcgcgaggaccagtggtgcggcagcctgatcgggctcaccgcccgggccacgtgggccaccaacatccaggtggccatcaaccaggtgcgccggctgatcggcaacgagaactacctggactacatgacctccatgaagcgcttcaagaacgagagcgaccccgagggggcgctctggtga

SEQ ID NO: 8243 - RNA, 9879 nt, synthetic construct
  misc_feature 1..9879: note = derived and/or modified CDS sequence (opt1) from DENV-1__JN819411__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcgtcggccagctgacctggaacgacctcatccgcctgtgcatcatggtgggggccaacgcgtccgaccggatgggcatgggcaccacctacctggccctcatggccacgttcaagatgcgcccgatgttcgccgtggggctgctgttccggcgcctcaccagccgggaggtcctgctgctcaccatcgggctgtccctggtggccagcgtcgagctccccaactccctggaggagctgggggacggcctcgcgatgggcatcatgatgctgaagctgctcaccgagttccagccccaccagctgtggacgaccctgctcagcctgaccttcgtgaagaccacgctgtccctcgactacgcctggaagaccaccgccatggtgctgagcatcgtctccctgttccccctctgcctgagcaccacgtcccagaagaccacctggctgccggtgctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtccccctcgcgggcccgctgatcgccggcgggatgctgatcgcctgctacgtgatcagcggctccagcgccgacctctccctggagaaggccgcggaggtgagctgggagcaggaggccgagcactccggggccagccacaacatcctggtcgaggtgcaggacgacggcacgatgaagatcaaggacgaggagcgggacgacaccctcaccatcctgctgaaggccaccctcctggccgtgtccggggtctaccccatgagcatccccgcgacgctgttcgtgtggtacttctggcagaagaagaagcagcgctccggcgtgctctgggacacccccagcccgcccgaggtcgagcgggccgtgctggacgacggcatctaccgcatcctgcagcgggggctgctcggccgctcccaggtgggggtcggcgtgttccaggacggggtgttccacaccatgtggcacgtcacccggggcgccgtgctgatgtaccagggcaagcgcctggagcccagctgggcctccgtgaagaaggacctcatcagctacgggggcgggtggcggttccagggctcctggaacacgggggaggaggtccaggtgatcgccgtggagcccggcaagaacccgaagaacgtccagaccacccccggcaccttcaagacgcccgagggggaggtgggcgcgatcgccctggacttcaagcccgggaccagcggctccccgatcgtgaaccgcgagggcaagatcgtcgggctgtacggcaacggggtggtgaccaccagcggcacgtacgtctccgccatcgcccaggccaaggcgagccaggaggggcccctccccgagatcgaggacgaggtgttcaagaagcggaacctgaccatcatggacctgcacccgggcagcggcaagacccgccggtacctccccgccatcgtgcgcgaggccatcaagcggaagctgcgcaccctgatcctcgcccccacgcgcgtcgtggcgtccgagatggccgaggccctgaaggggatgcccatccggtaccagaccaccgccgtcaagagcgagcacaccggccgcgagatcgtcgacctgatgtgccacgccacgttcaccatgcggctcctgtccccggtgcgcgtgcccaactacaacatgatcatcatggacgaggcgcacttcaccgaccccgccagcatcgccgcccgggggtacatctccacccgcgtcggcatgggggaggccgcggccatcttcatgacggccacgccgcccggcagcgtggaggccttcccccagtccaacgccgtgatccaggacgaggagcgggacatccccgagcgcagctggaactccggctacgactggatcaccgacttccccgggaagaccgtctggttcgtgcccagcatcaagtccggcaacgacatcgcgaactgcctgcggaagaacgggaagcgcgtgatccagctcagccggaagacgttcgacaccgagtaccagaagaccaagaacaacgactgggactacgtcgtgaccacggacatctccgagatgggcgccaacttccgcgccgaccgggtgatcgacccccgccggtgcctgaagcccgtcatcctgaaggacgggcccgagcgcgtgatcctcgccggcccgatgcccgtcaccgtggcgagcgccgcccagcggcgcggccggatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagacgttcgtcgagctcatgcgccggggcgacctgcccgtgtggctgagctacaaggtggcctccgaggggttccagtacagcgaccgccggtggtgcttcgacggcgagcgcaacaaccaggtcctcgaggagaacatggacgtggagatctggaccaaggagggggagcggaagaagctgcgcccccggtggctggacgcgcgcacctactccgacccgctcgccctgcgggagttcaaggagttcgccgccggccgccggagcgtgagcggcgacctgatcctcgagatcgggaagctgccccagcacctgaccctccgcgcccagaacgcgctggacaacctggtcatgctccacaactccgagcagggcgggaaggcctaccggcacgccatggaggagctgcccgacaccatcgagacgctgatgctcctggccctgatcgcggtgctcaccggcggggtgaccctgttcttcctgagcggcaagggcctcgggaagacctccatcggcctgctgtgcgtcacggccagctccgccctcctgtggatggccagcgtggagccccactggatcgccgcgtccatcatcctggagttcttcctcatggtgctgctgatcccggagcccgaccgccagcggacgccccaggacaaccagctcgcctacgtcgtgatcgggctgctgttcatgatcctcaccgtggccgccaacgagatgggcctgctggagaccacgaagaaggacctcgggatcggctacgtcgccgcggagaaccaccagcacgccaccatgctggacgtggacctgcgcccggccagcgcctggaccctctacgccgtggcgaccacggtcatcacccccatgatgcggcacaccatcgagaacaccacggccaacatctccctgaccgccatcgccaaccaggccgcgatcctgatgggcctcgacaaggggtggcccatcagcaagatggacatcggcgtgcccctgctggccctcgggtgctactcccaggtgaacccgctgaccctgaccgccgccgtcctcatgctggtggcgcactacgccatcatcggccccgggctgcaggccaaggccacgcgcgaggcccagaagcgcaccgcggccggcatcatgaagaaccccaccgtggacggcatcgtcgccatcgacctcgaccccgtggtgtacgacgccaagttcgagaagcagctggggcagatcatgctgctcatcctgtgcaccagccagatcctgctcatgcggacgacctgggccctgtgcgagtccatcaccctggcgaccggcccgctcacgaccctgtgggaggggagccccggcaagttctggaacaccaccatcgccgtctccatggccaacatcttccgcggcagctacctggccggggccggcctcgcgttctccctgatgaagtccctcgggggcgggcggcgcgggacgggcgcccagggggagaccctcggcgagaagtggaagcggcagctgaaccagctgtccaagagcgagttcaacacctacaagcgcagcgggatcatggaggtggaccggtccgaggccaaggagggcctcaagcgcggggagaccacgaagcacgccgtgagccggggcaccgcgaagctgcgctggttcgtcgagcggaacctggtgaagcccgagggcaaggtgatcgacctggggtgcggccgcgggggctggtcctactactgcgccgggctcaagaaggtcaccgaggtgaagggctacaccaagggcgggcccggccacgaggagccggtgcccatggccacctacgggtggaacctggtcaagctgcacagcggcaaggacgtgttcttcatgccgcccgagaagtgcgacacgctcctgtgcgacatcggggagtccagcccgaaccccaccatcgaggagggccggaccctgcgcgtgctcaagatggtcgagccctggctgaagggcaaccagttctgcatcaagatcctgaacccctacatgccgtccgtggtggagaccctcgagcagatgcagcggaagcacgggggcatgctggtccgcaaccccctgagccggaactccacgcacgagatgtactgggtgagctgcgggaccggcaacatcgtgtccgccgtcaacatgaccagccgcatgctcctgaaccggttcaccatggcccaccgcaagcccacgtacgagcgcgacgtggacctgggcgcggggacccggcacgtggccgtcgagcccgaggtggccaacctcgacatcatcggccagcgcatcgagaacatcaagaacgagcacaagctgacctggcactacgacgaggacaacccgtacaagacctgggcctaccacgggtcctacgaggtcaagcccagcggctccgccagctccatggtgaacggggtggtccggctgctcacgaagccctgggacgtgatccccatggtgacccagatcgcgatgaccgacaccacgccgttcggccagcagcgcgtcttcaaggagaaggtggacacccggacgccccgcgccaagcggggcaccacgcagatcatggaggtgaccgccaagtggctgtgggggttcctgagccgcaacaagaagccccggatctgcacccgcgaggagttcacccggaaggtccgctccaacgccgccatcggcgcggtgttcgtggacgagaaccagtggaacagcgccaaggaggccgtcgaggacgagcggttctgggacctcgtgcaccgcgagcgggagctgcacaagcaggggaagtgcgccacgtgcgtgtacaacatgatgggcaagcgcgagaagaagctgggggagttcggcaaggcgaagggcagccgggccatctggtacatgtggctcggggcccgcttcctggagttcgaggccctgggcttcatgaacgaggaccactggttctcccgggagaacagcctctccggggtcgagggcgaggggctgcacaagctgggctacatcctccgcgacatcagcaagatcccgggcgggaacatgtacgccgacgacaccgcgggctgggacacccggatcaccgaggacgacctgcagaacgaggccaagatcacggacatcatggagcccgagcacgccctgctcgccacctccatcttcaagctgacctaccagaacaaggtggtgcgcgtccagcgccccgccaagaacgggaccgtgatggacgtgatcagccggcgcgaccagcggggctccggccaggtcgggacgtacggcctgaacaccttcaccaacatggaggtgcagctcatccgccagatggagagcgaggggatcttctcccccagcgagctggagaccccgaacctggcggagcgggtgctcgactggctggagaagcacggcgccgagcgcctgaagcggatggccatctccggggacgactgcgtcgtgaagcccatcgacgaccgcttcgccacggccctcaccgcgctgaacgacatgggcaaggtgcggaaggacatcccccagtgggagcccagcaagggctggaacgactggcagcaggtcccgttctgctcccaccacttccaccagctgatcatgaaggacgggcgcgagatcgtggtgccctgccggaaccaggacgagctcgtcggccgcgcccgggtgagccagggggccggctggtccctgcgcgagaccgcctgcctgggcaagagctacgcccagatgtggcagctcatgtacttccaccggcgcgacctgcggctggcggccaacgccatctgctccgccgtgcccgtcgactgggtgcccaccagccgcaccacgtggagcatccacgcgcaccaccagtggatgaccaccgaggacatgctctccgtgtggaaccgggtctggatcgaggagaacccgtggatggaggacaagacccacgtgagctcctgggaggaggtgccctacctgggcaagcgcgaggaccagtggtgcggcagcctgatcgggctcacggcccgcgccacctgggccaccaacatccaggtcgccatcaaccaggtgcggcgcctgatcggcaacgagaactacctggactacatgacctccatgaagcggttcaagaacgagagcgaccccgagggggcgctctggtga

SEQ ID NO: 8244 - RNA, 9879 nt, synthetic construct
  misc_feature 1..9879: note = derived and/or modified CDS sequence (opt1) from DENV-1__FJ639812__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatgatgctcctgacgatgaaggagaagtcctggctggtccacaagcagtggttcctcgacctgccgctgccctggacctccggggccagcaccagccaggagacctggaaccggcaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtgatgtgcaccgggagcttcaagctggagaaggaggtcgcggagacccagcacggcacggtgctggtgcaggtcaagtacgagggcaccgacgccccctgcaagatccccttctccacccaggacgagaagggggtgacccagaacggccggctcatcacggccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtcttcacctccgtggggaagctggtgcaccaggtcttcggcaccgcctacggggtgctgttcagcggcgtgtcctggaccatgaagatcgggatcggcatcctcctgacgtggctgggcctcaacagccgctccaccagcctgtccatgacctgcatcgccgtcgggatggtgaccctgtacctcggcgtgatggtccaggccgacagcgggtgcgtgatcaactggaagggccgggagctgaagtgcgggtccggcatcttcgtgacgaacgaggtccacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtggtcgtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtggaggactacgggttcggcatcttcaccacgaacatctggctgaagctccgggactcctacacccagatgtgcgaccaccgcctgatgagcgcggccatcaaggactccaaggccgtccacgccgacatgggctactggatcgagagcgagaagaacgagacctggaagctggcccgggcgtccttcatcgaggtgaagacctgcacgtggcccaagagccacaccctctggtccaacggggtgctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtcgtggtggacgagcactgcgggaaccggggcccgagcctccgcaccaccacggtcaccgggaagatcatccacgagtggtgctgccggtcctgcaccctgccgcccctgcgcttccggggcgaggacgggtgctggtacggcatggagatccgccccgtgaaggagaaggaggagaacctcgtgcggagcatggtctccgccggcagcggggaggtggacagcttctccctgggcatcctgtgcgtgagcatcatgatcgaggaggtcatgcgctcccggtggagccgcaagatgctcatgaccgggacgctggccgtgttcctgctcctgatcatgggccagctgacctggaacgacctcatccgcctgtgcatcatggtgggggccaacgcgtccgaccggatgggcatgggcaccacctacctggccctcatggccacgttcaagatgcgcccgatgttcgccgtcgggctgctgttccggcgcctcaccagccgggaggtgctgctgctcaccatcgggctgtccctggtggccagcgtcgagctccccaactccctggaggagctgggggacggcctcgcgatgggcatcatgatgctgaagctgctcaccgagttccagccccaccagctgtggacgaccctgctcagcctgaccttcgtgaagaccacgctgtccctcgactacgcctggaagaccaccgccatggtcctgagcatcgtgtccctgttccccctctgcctgagcaccacgtcccagaagaccacctggctgccggtgctcctggggagcttcggctgcaagcccctgaccatgttcctcatcaccgagaacaagatctgggggcgcaagtcctggcccctgaacgagggcatcatggccatcgggatcgtcagcatcctgctctccagcctgctgaagaacgacgtgcccctcgcgggcccgctgatcgccggcgggatgctgatcgcctgctacgtgatcagcggctccagcgccgacctcctgctggagaaggccgcggaggtctcctgggagcaggaggccgagcacagcggggcctcccacaacatcctcgtggaggtgcaggacgacggcacgatgaagatcaaggacgaggagcgggacgacaccctgaccatcctgctcaaggccaccctgctggccgtcagcggggtgtaccccatgtccatccccgcgaccctcttcgtgtggtacttctggcagaagaagaagcagcgcagcggcgtcctgtgggacaccccctccccgcccgaggtggagcgggccgtgctggacgacggcatctaccgcatcctgcagcgggggctcctgggccgcagccaggtcggggtgggcgtgttccaggacggggtcttccacaccatgtggcacgtgacccggggcgccgtgctgatgtaccagggcaagcgcctcgagccctcctgggccagcgtcaagaaggacctgatctcctacgggggcgggtggcggttccagggcagctggaacacgggggaggaggtccaggtgatcgccgtcgagcccggcaagaacccgaagaacgtgcagaccacccccggcaccttcaagacgcccgagggggaggtgggcgcgatcgccctggacttcaagcccgggacctccggcagcccgatcgtcaaccgcgagggcaagatcgtggggctctacggcaacggggtggtcaccacctccggcacgtacgtgagcgccatcgcccaggccaaggcgtcccaggaggggcccctgcccgagatcgaggacgaggtgttcaagaagcggaacctgaccatcatggacctccacccgggcagcggcaagacccgccggtacctgcccgccatcgtccgcgaggccatcaagcggaagctgcgcaccctcatcctggcccccacgcgcgtggtggcgagcgagatggccgaggccctgaaggggatgcccatccggtaccagaccaccgccgtcaagtccgagcacaccggccgcgagatcgtggacctcatgtgccacgccacgttcaccatgcggctgctgagcccggtgcgcgtccccaactacaacatgatcatcatggacgaggcgcacttcaccgaccccgcctccatcgccgcccgggggtacatcagcacccgcgtgggcatgggggaggccgcggccatcttcatgacggccacgccgcccggctccgtggaggccttcccccagagcaacgccgtcatccaggacgaggagcgggacatccccgagcgctcctggaacagcggctacgactggatcaccgacttccccgggaagaccgtgtggttcgtgccctccatcaagagcggcaacgacatcgcgaactgcctccggaagaacgggaagcgcgtcatccagctgtcccggaagacgttcgacaccgagtaccagaagaccaagaacaacgactgggactacgtggtgaccacggacatcagcgagatgggcgccaacttccgcgccgaccgggtcatcgacccccgccggtgcctgaagcccgtgatcctcaaggacgggcccgagcgcgtgatcctggccggcccgatgcccgtcaccgtggcgtccgccgcccagcggcgcggccggatcgggcgcaaccagaacaaggagggcgaccagtacgtctacatggggcagcccctgaacaacgacgaggaccacgcccactggaccgaggccaagatgctcctggacaacatcaacacccccgagggcatcatcccggcgctgttcgagcccgagcgcgagaagtccgccgccatcgacggggagtaccggctccgcggcgaggcccggaagacgttcgtggagctgatgcgccggggcgacctgcccgtgtggctctcctacaaggtcgccagcgaggggttccagtactccgaccgccggtggtgcttcgacggcgagcgcaacaaccaggtgctggaggagaacatggacgtggagatctggaccaaggagggggagcggaagaagctgcgcccccggtggctcgacgcgcgcacctacagcgacccgctggccctgcgggagttcaaggagttcgccgccggccgccggtccgtcagcggcgacctcatcctggagatcgggaagctgccccagcacctcaccctgcgcgcccagaacgcgctggacaacctcgtgatgctgcacaacagcgagcagggcgggaaggcctaccggcacgccatggaggagctgcccgacaccatcgagacgctcatgctgctggccctcatcgcggtgctgaccggcggggtcaccctgttcttcctctccggcaagggcctggggaagaccagcatcggcctgctctgcgtgacggcctccagcgccctgctgtggatggcctccgtggagccccactggatcgccgcgagcatcatcctcgagttcttcctgatggtcctgctcatcccggagcccgaccgccagcggacgccccaggacaaccagctggcctacgtggtgatcgggctcctcttcatgatcctgaccgtcgccgccaacgagatgggcctgctcgagaccacgaagaaggacctggggatcggctacgtggccgcggagaaccaccagcacgccaccatgctggacgtggacctccgcccggcctccgcctggaccctgtacgccgtcgcgaccacggtgatcacccccatgatgcggcacaccatcgagaacaccacggccaacatcagcctgaccgccatcgccaaccaggccgcgatcctcatgggcctggacaaggggtggcccatctccaagatggacatcggcgtgcccctgctcgccctggggtgctacagccaggtcaacccgctgaccctcaccgccgccgtgctgatgctggtggcgcactacgccatcatcggccccgggctccaggccaaggccacgcgcgaggcccagaagcgcaccgcggccggcatcatgaagaaccccaccgtcgacggcatcgtggccatcgacctggaccccgtggtctacgacgccaagttcgagaagcagctggggcagatcatgctcctgatcctgtgcacctcccagatcctcctgatgcggacgacctgggccctgtgcgagagcatcaccctcgcgaccggcccgctgacgaccctgtgggaggggtcccccggcaagttctggaacaccaccatcgccgtgagcatggccaacatcttccgcggctcctacctcgccggggccggcctggcgttcagcctgatgaagtccctcgggggcgggcggcgcggcacgggcgcccagggggagaccctgggcgagaagtggaagcggcagctgaaccagctcagcaagtccgagttcaacacctacaagcgcagcgggatcatggaggtggaccggagcgaggccaaggagggcctgaagcgcggggagaccacgaagcacgccgtctcccggggcaccgcgaagctgcgctggttcgtggagcggaacctggtgaagcccgagggcaaggtcatcgacctcgggtgcggccgcgggggctggagctactactgcgccgggctgaagaaggtgaccgaggtgaagggctacaccaagggcgggcccggccacgaggagccgatccccatggccacctacgggtggaacctggtcaagctccactccggcaaggacgtgttcttcatgccgcccgagaagtgcgacacgctgctgtgcgacatcggggagagctccccgaaccccaccatcgaggagggccggaccctccgcgtgctgaagatggtcgagccctggctgaagggcaaccagttctgcatcaagatcctcaacccctacatgccgagcgtggtggagaccctggagcagatgcagcggaagcacgggggcatgctggtccgcaaccccctctcccggaacagcacgcacgagatgtactgggtgtcctgcgggaccggcaacatcgtgagcgccgtcaacatgacctcccgcatgctgctgaaccggttcaccatggcccaccgcaagcccacgtacgagcgcgacgtggacctcggcgcggggacccggcacgtggccgtcgagcccgaggtggccaacctggacatcatcggccagcgcatcgagaacatcaagaacgagcacaagagcacctggcactacgacgaggacaacccgtacaagacctgggcctaccacgggtcctacgaggtgaagcccagcggctccgccagctccatggtcaacggggtggtccggctgctcacgaagccctgggacgtgatccccatggtgacccagatcgcgatgaccgacaccacgccgttcggccagcagcgcgtcttcaaggagaaggtggacacccggacgccccgcgccaagcggggcaccacgcagatcatggaggtgaccgccaagtggctgtgggggttcctgagccgcaacaagaagccccggatctgcacccgcgaggagttcacccggaaggtccgctccaacgccgccatcggcgcggtgttcgtggacgagaaccagtggaacagcgccaaggaggccgtcgaggacgagcggttctgggacctcgtgcaccgcgagcgggagctgcacaagcaggggaagtgcgccacgtgcgtgtacaacatgatgggcaagcgcgagaagaagctgggggagttcggcaaggcgaagggcagccgggccatctggtacatgtggctcggggcccgcttcctggagttcgaggccctgggcttcatgaacgaggaccactggttctcccgggagaacagcctctccggggtcgagggcgaggggctgcacaagctgggctacatcctccgcgacatcagcaagatcccgggcgggaacatgtacgccgacgacaccgcgggctgggacacccggatcaccgaggacgacctgcagaacgaggccaagatcacggacatcatggagcccgagcacgccctgctcgccacctccatcttcaagctgacctaccagaacaaggtggtgcgcgtccagcgccccgccaagaacgggaccgtgatggacgtgatcagccggcgcgaccagcggggctccggccaggtcgggacgtacggcctgaacaccttcaccaacatggaggtgcagctcatccgccagatggagagcgaggggatcttcctgccctccgagctggagaccccgaacctcgcggagcgggtgctggactggctggagaagcacggcgccgagcgcctcaagcggatggccatcagcggggacgactgcgtcgtgaagcccatcgacgaccgcttcgccacggccctgaccgcgctgaacgacatgggcaaggtgcggaaggacatcccccagtgggagccctccaagggctggaacgactggcagcaggtcccgttctgcagccaccacttccaccagctcatcatgaaggacgggcgcgagatcgtggtgccctgccggaaccaggacgagctggtcggccgcgcccgggtgtcccagggggccggctggagcctgcgcgagaccgcctgcctcgggaagtcctacgcccagatgtggcagctgatgtacttccaccggcgcgacctgcggctcgcggccaacgccatctgcagcgccgtgcccgtcgactgggtgcccacctcccgcaccacgtggagcatccacgcgcaccaccagtggatgaccaccgaggacatgctgagcgtgtggaaccgggtctggatcgaggagaacccgtggatggaggacaagacccacgtgtccagctgggaggaggtgccctacctgggcaagcgcgaggaccagtggtgcggctccctcatcgggctgacggcccgcgccacctgggccaccaacatccaggtcgccatcaaccaggtgcggcgcctgatcggcaacgagaactacctcgactacatgaccagcatgaagcggttcaagaacgagtccgaccccgagggggcgctgtggtga

SEQ ID NO: 8245 - RNA, 9879 nt, synthetic construct
  misc_feature 1..9879: note = derived and/or modified CDS sequence (opt1) from DENV-1__FJ639813__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcatgaaccccgcggtgctccggaagctgtgcatcgaggccaagatcagcaacaccaccaccgactcccgctgccccacgcagggcgaggccaccctggtggaggagcaggacgccaacttcgtctgccggcgcaccttcgtggaccggggctgggggaacggctgcggcctcttcggcaaggggagcctgctgacctgcgccaagttcaagtgcgtgacgaagctcgagggcaagatcgtccagtacgagaacctgaagtactccgtgatcgtgaccgtccacaccggcgaccagcaccaggtggggaacgagaccacggagcacggcaccatcgcgaccatcacgccccaggcccccaccagcgagatccagctgacggactacggggccctcaccctggactgcagcccccgcaccggcctggacttcaacgagatggtcctcctgaccatgaaggagaagtcctggctggtgcacaagcagtggttcctcgacctgccgctgccctggacgtccggggccagcaccagccaggagacctggaaccggcaggacctcctggtgaccttcaagacggcccacgcgaagaagcaggaggtcgtggtgctgggctcccaggagggcgccatgcacaccgccctcaccggggccaccgagatccagacgagcggcaccaccaccatcttcgccgggcacctgaagtgccgcctgaagatggacaagctcacgctgaagggcatgtcctacgtcatgtgcaccgggagcttcaagctggagaaggaggtggcggagacccagcacggcaccgtgctggtccaggtgaagtacgagggcacggacgccccctgcaagatccccttctccacccaggacgagaagggggtgacccagaacggccggctcatcaccgccaacccgatcgtcacggacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacaccgcgtgggacttcgggagcatcggcggcgtgttcacgtccgtggggaagctggtccaccaggtgttcggcaccgcctacggggtgctgttcagcggcgtctcctggaccatgaagatcgggatcggcatcctcctgacctggctgggcctcaacagccgctccacgagcttctccatgacctgcatcgccgtggggatggtgaccctgtacctgggcgtcatggtgcaggccgacagcgggtgcgtgatcaactggaagggccgggagctcaagtgcgggtccggcatcttcgtcaccaacgaggtgcacacgtggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcgcgcaggggaagaagatgatccggccccagcccatggagcacaagtactcctggaagtcctggggcaaggccaagatcatcggcgccgacatccagaacaccacgttcatcatcgacgggcccgacaccccggagtgccccgacggccagcgcgcctggaacatctgggaggtcgaggactacgggttcggcatcttcaccaccaacatctggctgaagctgcgggactcctacacgcagatgtgcgaccaccgcctcatgagcgcggccatcaaggactccaaggccgtgcacgccgacatgggctactggatcgagagcgagaagaacgagacctggaagctggcccgggcgtccttcatcgaggtgaagacctgcacctggcccaagagccacacgctgtggtccaacggggtcctcgagagcgagatgatcatccccaagatctacggcgggccgatctcccagcacaactaccgccccggctacttcacccagaccgccgggccctggcacctgggcaagctggagctcgacttcgacctgtgcgagggcaccacggtggtggtcgacgagcactgcgggaaccggggcccgagcctgcgcaccaccaccgtgacggggaagatcatccacgagtggtgctgccggtcctgcaccctgccgcccctgcgcttccggggcgaggacgggtgctggtacggcatggagatccgccccgtgaaggagaaggaggagaacctggtccggagcatggtgtccgccggcagcggggaggtggacagcttctccctcggcatcctgtgcgtcagcatcatgatcgaggaggtgatgcgctcccggtggagccgcaagatgctgatgaccgggaccctcgccgtgttcctgctgctcatcatgggccagctgacgtggaacgacctgatccgcctctgcatcatggtcggggccaacgcgtccgaccggatgggcatgggcaccacctacctggccctgatggccaccttcaagatgcgcccgatgttcgccgtggggctcctgttccggcgcctgacgagccgggaggtgctcctgctgaccatcgggctctccctggtcgccagcgtggagctgcccaactccctcgaggagctgggggacggcctggcgatgggcatcatgatgctcaagctgctgaccgagttccagccccaccagctctggaccacgctgctgagcctcaccttcgtcaagaccaccctgtccctggactacgcctggaagacgaccgccatggtgctcagcatcgtgtccctgttccccctgtgcctcagcaccacctcccagaagacgacctggctgccggtcctgctcgggagcttcggctgcaagcccctgaccatgttcctgatcaccgagaacaagatctgggggcgcaagtcctggcccctcaacgagggcatcatggccatcgggatcgtgagcatcctgctgtccagcctcctgaagaacgacgtgcccctggcgggcccgctcatcgccggcgggatgctgatcgcctgctacgtcatcagcggctccagcgccgacctgtccctcgagaaggccgcggaggtgagctgggagcaggaggccgagcactccggggccagccacaacatcctggtggaggtccaggacgacggcaccatgaagatcaaggacgaggagcgggacgacacgctgaccatcctcctgaaggccaccctgctcgccgtgtccggggtgtaccccatgagcatccccgcgaccctgttcgtctggtacttctggcagaagaagaagcagcgctccggcgtgctgtgggacacgcccagcccgcccgaggtggagcgggccgtcctcgacgacggcatctaccgcatcctgcagcgggggctgctgggccgctcccaggtgggggtgggcgtcttccaggacggggtgttccacaccatgtggcacgtgacccggggcgccgtcctcatgtaccagggcaagcgcctggagcccagctgggcctccgtgaagaaggacctgatcagctacgggggcgggtggcggttccagggctcctggaacaccggggaggaggtgcaggtcatcgccgtggagcccggcaagaacccgaagaacgtgcagacgacccccggcaccttcaagacccccgagggggaggtcggcgcgatcgccctcgacttcaagcccgggacgagcggctccccgatcgtgaaccgcgagggcaagatcgtggggctgtacggcaacggggtcgtgaccaccagcggcacctacgtgtccgccatcgcccaggccaaggcgagccaggaggggcccctgcccgagatcgaggacgaggtcttcaagaagcggaacctcacgatcatggacctgcacccgggcagcggcaagacccgccggtacctgcccgccatcgtgcgcgaggccatcaagcggaagctccgcaccctgatcctggcccccacccgcgtggtcgcgtccgagatggccgaggccctcaaggggatgcccatccggtaccagacgaccgccgtcaagagcgagcacaccggccgcgagatcgtggacctgatgtgccacgccaccttcacgatgcggctgctctccccggtccgcgtgcccaactacaacatgatcatcatggacgaggcgcacttcaccgaccccgccagcatcgccgcccgggggtacatctccacccgcgtgggcatgggggaggccgcggccatcttcatgaccgccacgcccccgggcagcgtcgaggccttcccccagtccaacgccgtgatccaggacgaggagcgggacatccccgagcgcagctggaactccggctacgactggatcaccgacttccccgggaagaccgtgtggttcgtcccgagcatcaagtccggcaacgacatcgcgaactgcctgcggaagaacgggaagcgcgtgatccagctgagccggaagaccttcgacacggagtaccagaagaccaagaacaacgactgggactacgtggtcaccaccgacatctccgagatgggcgccaacttccgcgccgaccgggtgatcgacccccgccggtgcctcaagcccgtgatcctgaaggacgggcccgagcgcgtcatcctggccggcccgatgcccgtgacggtcgcgagcgccgcccagcggcgcggccggatcgggcgcaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgcgagaagtccgccgccatcgacggggagtaccggctgcgcggcgaggcccggaagaccttcgtggagctgatgcgccggggcgacctccccgtctggctgagctacaaggtggcctccgaggggttccagtacagcgaccgccggtggtgcttcgacggcgagcgcaacaaccaggtgctggaggagaacatggacgtcgagatctggacgaaggagggggagcggaagaagctccgcccccggtggctggacgcgcgcacctactccgacccgctggccctccgggagttcaaggagttcgccgccggccgccggagcgtgagcggcgacctgatcctggagatcgggaagctcccccagcacctgaccctgcgcgcccagaacgcgctcgacaacctggtgatgctgcacaactccgagcagggcgggaaggcctaccggcacgccatggaggagctccccgacaccatcgagaccctgatgctgctcgccctgatcgcggtcctgacgggcggggtgaccctcttcttcctgagcggcaagggcctggggaagacctccatcggcctcctgtgcgtgaccgccagctccgccctgctctggatggccagcgtcgagccccactggatcgccgcgtccatcatcctggagttcttcctgatggtgctcctgatcccggagcccgaccgccagcggacgccccaggacaaccagctggcctacgtggtcatcgggctcctgttcatgatcctgaccgtggccgccaacgagatgggcctcctggagaccaccaagaaggacctggggatcggctacgtggccgcggagaaccaccagcacgccacgatgctcgacgtcgacctgcgcccggccagcgcctggaccctgtacgccgtggcgaccaccgtgatcacgcccatgatgcggcacaccatcgagaacaccaccgccaacatctccctcacggccatcgccaaccaggccgcgatcctgatgggcctggacaaggggtggcccatcagcaagatggacatcggcgtccccctcctggccctggggtgctactcccaggtgaacccgctcaccctgaccgccgccgtgctgatgctcgtcgcgcactacgccatcatcggccccgggctgcaggccaaggccacccgcgaggcccagaagcgcacggcggccggcatcatgaagaaccccaccgtggacggcatcgtggccatcgacctggaccccgtcgtgtacgacgccaagttcgagaagcagctcgggcagatcatgctgctgatcctctgcaccagccagatcctgctgatgcggaccacgtgggccctctgcgagtccatcaccctggcgaccggcccgctgaccacgctctgggaggggagccccggcaagttctggaacaccaccatcgccgtgtccatggccaacatcttccgcggcagctacctggccggggccggcctggcgttctccctcatgaagtccctcgggggcgggcggcgcgggaccggcgcccagggggagacgctgggcgagaagtggaagcggcagctcaaccagctgtccaagagcgagttcaacacctacaagcgcagcgggatcatggaggtcgaccggtccgaggccaaggagggcctgaagcgcggggagaccaccaagcacgccgtgagccggggcacggcgaagctccgctggttcgtggagcggaacctggtcaagcccgagggcaaggtgatcgacctggggtgcggccgcgggggctggtcctactactgcgccgggctgaagaaggtgaccgaggtcaagggctacaccaagggcgggcccggccacgaggagccgatgcccatggccacctacgggtggaacctcgtgaagctgcacagcggcaaggacgtgttcttcatgccgcccgagaagtgcgacaccctgctctgcgacatcggggagtccagcccgaaccccacgatcgaggagggccggaccctgcgcgtcctgaagatggtggagccctggctcaagggcaaccagttctgcatcaagatcctgaacccctacatgccgtccgtggtcgagaccctggagcagatgcagcggaagcacgggggcatgctcgtgcgcaaccccctgagccggaactccacccacgagatgtactgggtgagctgcgggacgggcaacatcgtctccgccgtgaacatgaccagccgcatgctgctcaaccggttcaccatggcccaccgcaagcccacctacgagcgcgacgtggacctgggcgcggggacgcggcacgtcgccgtggagcccgaggtggccaacctggacatcatcggccagcgcatcgagaacatcaagaacgagcacaagtccacctggcactacgacgaggacaacccgtacaagacctgggcctaccacgggagctacgaggtcaagccctccggcagcgcctccagcatggtgaacggggtcgtgcggctcctgaccaagccctgggacgtgatccccatggtcacgcagatcgcgatgaccgacaccaccccgttcggccagcagcgcgtgttcaaggagaaggtggacacgcggacgccccgcgccaagcggggcaccacccagatcatggaggtcacggccaagtggctgtgggggttcctctcccgcaacaagaagccccggatctgcacccgcgaggagttcacccggaaggtgcgcagcaacagcgccatcggcgccgtgttcgtcgacgagaaccagtggaactccgcgaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaagggcagccgggcgatctggtacatgtggctgggggcccgcttcctggagttcgaggccctcggcttcatgaacgaggaccactggttctcccgggagaacagcctgtccggggtggagggcgaggggctgcacaagctcggctacatcctgcgcgacatcagcaagatcccgggcgggaacatgtacgccgacgacacggccggctgggacacccggatcaccgaggacgacctgcagaacgaggcgaagatcaccgacatcatggagcccgagcacgccctcctggccacgtccatcttcaagctgacctaccagaacaaggtggtccgcgtgcagcgccccgccaagaacgggaccgtgatggacgtcatcagccggcgcgaccagcggggctccggccaggtggggacctacggcctcaacacgttcaccaacatggaggtgcagctgatccgccagatggagagcgaggggatcttctcccccagcgagctggagaccccgaacctcgccgagcgggtcctggactggctggagaagcacggcgcggagcgcctcaagcggatggccatctccggggacgactgcgtggtgaagcccatcgacgaccgcttcgccaccgccctgacggccctgaacgacatgggcaaggtccggaaggacatcccccagtgggagcccagcaagggctggaacgactggcagcaggtcccgttctgctcccaccacttccaccagctcatcatgaaggacgggcgcgagatcgtggtcccctgccggaaccaggacgagctggtgggccgcgcgcgggtgagccagggggccggctggtccctgcgcgagaccgcctgcctcggcaagagctacgcccagatgtggcagctgatgtacttccaccggcgcgacctgcggctcgccgcgaacgccatctgcagcgccgtccccgtggactgggtgcccacctcccgcaccacctggagcatccacgcccaccaccagtggatgacgaccgaggacatgctgtccgtctggaaccgggtgtggatcgaggagaacccgtggatggaggacaagacccacgtgagctcctgggaggaggtcccctacctgggcaagcgcgaggaccagtggtgcggcagcctcatcgggctgaccgcgcgcgccacgtgggccaccaacatccaggtggccatcaaccaggtgcggcgcctgatcggcaacgagaactacctcgactacatgacctccatgaagcggttcaagaacgagagcgaccccgagggggccctgtggtga

SEQ ID NO: 8246 - RNA, 9879 nt, synthetic construct
  misc_feature 1..9879: note = derived and/or modified CDS sequence (opt1) from DENV-1__JN819412__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacctacctggccctcatggccacgttcaagatgcgcccgatgttcgccgtggggctgctgttccggcgcctcaccagccgggaggtgctgctgctcaccatcgggctgtccctggtcgccagcgtggagctccccaactccctggaggagctgggggacggcctcgcgatgggcatcatgatgctgaagctgctcaccgagttccagccccaccagctgtggacgaccctgctcagcctgaccttcgtcaagaccacgctgtccctcgactacgcctggaagaccaccgccatggtgctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctcctgctggagaaggccgcggaggtgtcctgggagcaggaggccgagcacagcggggcctcccacaacatcctcgtggaggtccaggacgacggcacgatgaagatcaaggacgaggagcgggacgacaccctgaccatcctgctcaaggccaccctgctggccgtgagcggggtgtaccccatgtccatccccgcgaccctcttcgtctggtacttctggcagaagaagaagcagcgcagcggcgtgctgtgggacaccccctccccgcccgaggtggagcgggccgtcctggacgacggcatctaccgcatcctgcagcgggggctcctgggccgcagccaggtgggggtgggcgtcttccaggacggggtgttccacaccatgtggcacgtgacccggggcgccgtcctgatgtaccagggcaagcgcctcgagccctcctgggccagcgtgaagaaggacctgatctcctacgggggcgggtggcggttccagggcagctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggacctccggcagcccgatcgtgaaccgcgagggcaagatcgtggggctctacggcaacggggtcgtgaccacctccggcacgtacgtgagcgccatcgcccaggccaaggcgtcccaggaggggcccctgcccgagatcgaggacgaggtcttcaagaagcggaacctgaccatcatggacctccacccgggcagcggcaagacccgccggtacctgcccgccatcgtgcgcgaggccatcaagcggaagctgcgcaccctcatcctggcccccacgcgcgtggtcgcgagcgagatggccgaggccctgaaggggatgcccatccggtaccagaccaccgccgtgaagtccgagcacaccggccgcgagatcgtggacctcatgtgccacgccacgttcaccatgcggctgctgagcccggtccgcgtgcccaactacaacatgatcatcatggacgaggcgcacttcaccgaccccgcctccatcgccgcccgggggtacatcagcacccgcgtgggcatgggggaggccgcggccatcttcatgacggccacgccgcccggctccgtcgaggccttcccccagagcaacgccgtgatccaggacgaggagcgggacatccccgagcgctcctggaacagcggctacgactggatcaccgacttccccgggaagaccgtgtggttcgtcccctccatcaagagcggcaacgacatcgcgaactgcctccggaagaacgggaagcgcgtgatccagctgtcccggaagacgttcgacaccgagtaccagaagaccaagaacaacgactgggactacgtggtcaccacggacatcagcgagatgggcgccaacttccgcgccgaccgggtgatcgacccccgccggtgcctgaagcccgtgatcctcaaggacgggcccgagcgcgtcatcctggccggcccgatgcccgtgaccgtcgcgtccgccgcccagcggcgcggccggatcgggcgcaaccagaacaaggagggcgaccagtacgtgtacatggggcagcccctgaacaacgacgaggaccacgcccactggaccgaggccaagatgctcctggacaacatcaacacccccgagggcatcatcccggcgctgttcgagcccgagcgcgagaagtccgccgccatcgacggggagtaccggctccgcggcgaggcccggaagacgttcgtggagctgatgcgccggggcgacctgcccgtctggctctcctacaaggtggccagcgaggggttccagtactccgaccgccggtggtgcttcgacggcgagcgcaacaaccaggtgctggaggagaacatggacgtcgagatctggaccaaggagggggagcggaagaagctgcgcccccggtggctcgacgcgcgcacctacagcgacccgctggccctgcgggagttcaaggagttcgccgccggccgccggtccgtgagcggcgacctcatcctggagatcgggaagctgccccagcacctcaccctgcgcgcccagaacgcgctggacaacctcgtgatgctgcacaacagcgagcagggcgggaaggcctaccggcacgccatggaggagctgcccgacaccatcgagacgctcatgctgctggccctcatcgcggtcctgaccggcggggtgaccctgttcttcctctccggcaagggcctggggaagaccagcatcggcctgctctgcgtgacggcctccagcgccctgctgtggatggcctccgtcgagccccactggatcgccgcgagcatcatcctcgagttcttcctgatggtgctgctcatcccggagcccgaccgccagcggacgccccaggacaaccagctggcctacgtggtcatcgggctcctcttcatgatcctgaccgtggccgccaacgagatgggcctgctcgagaccacgaagaaggacctggggatcggctacgtggccgcggagaaccaccagcacgccaccatgctggacgtcgacctccgcccggcctccgcctggaccctgtacgccgtggcgaccacggtgatcacccccatgatgcggcacaccatcgagaacaccacggccaacatcagcctgaccgccatcgccaaccaggccgcgatcctcatgggcctggacaaggggtggcccatctccaagatggacatcggcgtccccctgctcgccctggggtgctacagccaggtgaacccgctgaccctcaccgccgccgtgctgatgctggtcgcgcactacgccatcatcggccccgggctccaggccaaggccacgcgcgaggcccagaagcgcaccgcggccggcatcatgaagaaccccaccgtggacggcatcgtggccatcgacctggaccccgtcgtgtacgacgccaagttcgagaagcagctggggcagatcatgctcctgatcctgtgcacctcccagatcctcctgatgcggacgacctgggccctgtgcgagagcatcaccctcgcgaccggcccgctgacgaccctgtgggaggggtcccccggcaagttctggaacaccaccatcgccgtgagcatggccaacatcttccgcggctcctacctcgccggggccggcctggcgttcagcctgatgaagtccctcgggggcgggcggcgcggcacgggcgcccagggggagaccctgggcgagaagtggaagcggcagctgaaccagctcagcaagtccgagttcaacacctacaagcgcagcgggatcatggaggtcgaccggagcgaggccaaggagggcctgaagcgcggggagaccacgaagcacgccgtgtcccggggcaccgcgaagctgcgctggttcgtggagcggaacctggtcaagcccgagggcaaggtgatcgacctcgggtgcggccgcgggggctggagctactactgcgccgggctgaagaaggtgaccgaggtcaagggctacaccaagggcgggcccggccacgaggagccgatccccatggccacctacgggtggaacctggtgaagctccactccggcaaggacgtgttcttcatgccgcccgagaagtgcgacacgctgctgtgcgacatcggggagagctccccgaaccccaccatcgaggagggccggaccctccgcgtcctgaagatggtggagccctggctgaagggcaaccagttctgcatcaagatcctcaacccctacatgccgagcgtggtcgagaccctggagcagatgcagcggaagcacgggggcatgctggtgcgcaaccccctctcccggaacagcacgcacgagatgtactgggtgtcctgcgggaccggcaacatcgtcagcgccgtgaacatgacctcccgcatgctgctgaaccggttcaccatggcccaccgcaagcccacgtacgagcgcgacgtggacctcggcgcggggacccggcacgtcgccgtggagcccgaggtggccaacctggacatcatcggccagcgcatcgagaacatcaagaacgagcacaagagcacctggcactacgacgaggacaacccgtacaagacctgggcctaccacgggtcctacgaggtcaagcccagcggctccgccagctccatggtgaacggggtcgtgcggctgctcacgaagccctgggacgtgatccccatggtcacccagatcgcgatgaccgacaccacgccgttcggccagcagcgcgtgttcaaggagaaggtggacacccggacgccccgcgccaagcggggcaccacgcagatcatggaggtcaccgccaagtggctgtgggggttcctgagccgcaacaagaagccccggatctgcacccgcgaggagttcacccggaaggtgcgctccaacgccgccatcggcgcggtgttcgtcgacgagaaccagtggaacagcgccaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggcgaagggcagccgggccatctggtacatgtggctcggggcccgcttcctggagttcgaggccctgggcttcatgaacgaggaccactggttctcccgggagaacagcctctccggggtggagggcgaggggctgcacaagctgggctacatcctccgcgacatcagcaagatcccgggcgggaacatgtacgccgacgacaccgcgggctgggacacccggatcaccgaggacgacctgcagaacgaggccaagatcacggacatcatggagcccgagcacgccctgctcgccacctccatcttcaagctgacctaccagaacaaggtggtccgcgtgcagcgccccgccaagaacgggaccgtgatggacgtcatcagccggcgcgaccagcggggctccggccaggtggggacgtacggcctgaacaccttcaccaacatggaggtgcagctcatccgccagatggagagcgaggggatcttcctgccctccgagctggagaccccgaacctcgcggagcgggtcctggactggctggagaagcacggcgccgagcgcctcaagcggatggccatcagcggggacgactgcgtggtgaagcccatcgacgaccgcttcgccacggccctgaccgcgctgaacgacatgggcaaggtccggaaggacatcccccagtgggagccctccaagggctggaacgactggcagcaggtcccgttctgcagccaccacttccaccagctcatcatgaaggacgggcgcgagatcgtggtcccctgccggaaccaggacgagctggtgggccgcgcccgggtgtcccagggggccggctggagcctgcgcgagaccgcctgcctcgggaagtcctacgcccagatgtggcagctgatgtacttccaccggcgcgacctgcggctcgcggccaacgccatctgcagcgccgtccccgtggactgggtgcccacctcccgcaccacgtggagcatccacgcgcaccaccagtggatgaccaccgaggacatgctgagcgtctggaaccgggtgtggatcgaggagaacccgtggatggaggacaagacccacgtgtccagctgggaggaggtcccctacctgggcaagcgcgaggaccagtggtgcggctccctcatcgggctgacggcccgcgccacctgggccaccaacatccaggtggccatcaaccaggtgcggcgcctgatcggcaacgagaactacctcgactacatgaccagcatgaagcggttcaagaacgagtccgaccccgagggggcgctgtggtga

SEQ ID NO: 8247 - RNA, 9879 nt, synthetic construct
  misc_feature 1..9879: note = derived and/or modified CDS sequence (opt1) from DENV-1__FJ810415__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtggagacctgggccctgcgccaccccgggttcacggtgatcgccttcttcctggcgcacgccatcggcaccagcatcacccagaagggggtgatcttcatcctcctgatgctggtcaccccctccatggccatgcggtgcgtgggcatcggcaaccgcgacttcgtggaggggctcagcggcgccacgtgggtcgacgtggtgctggagcacgggtcctgcgtcaccaccatggccaagaacaagcccaccctggacatcgagctcctgaagacggaggtgaccaaccccgcggtgctgcggaagctctgcatcgaggccaagatcagcaacaccaccacggactcccgctgcccgacccagggcgaggccaccctggtcgaggagcaggacgccaacttcgtgtgccggcgcaccttcgtggaccggggctgggggaacggctgcgggctgttcggcaaggggagcctcctgacgtgcgccaagttcaagtgcgtcaccaagctggagggcaagatcgtgcagtacgagaacctcaagtactccgtgatcgtcaccgtgcacaccggcgaccagcaccaggtcgggaacgagacgaccgagcacggcaccatcgcgaccatcacgccccaggcccccacgagcgagatccagctgaccgactacggggccctgaccctcgactgcagcccccggaccggcctggacttcaacgagatggtgctgctcacgatgaaggagaagtcctggctggtgcacaagcagtggttcctggacctcccgctgccctggacctccggggccagcaccagccaggagacctggaaccggcaggacctgctcgtcacgttcaagaccgcccacgcgaagaagcaggaggtggtggtcctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtgatgtgcaccgggagcttcaagctggagaaggaggtggcggagacccagcacggcacggtcctggtccaggtgaagtacgagggcaccgacgccccctgcaagatccccttctccacccaggacgagaagggggtcacccagaacggccggctgatcacggccaacccgatcgtgaccgacaaggagaagcccgtgaacatcgagaccgagccgcccttcggggagagctacatcgtcgtgggcgccggcgagaaggcgctcaagctgaactggttcaagcgcgggtccagcatcggcaagatgttcgaggccaccgcccgcggggcgcgccgcatggccatcctgggcgacacggcgtgggacttcgggtccatcggcggcgtgttcaccagcgtcgggaagctcgtgcaccaggtgttcggcaccgcctacggggtcctgttctccggcgtgagctggaccatgaagatcgggatcggcatcctgctcacgtggctgggcctgaactcccggagcacctccctcagcatgacctgcatcgccgtggggatggtcaccctgtacctgggcgtgatggtgcaggccgactccgggtgcgtcatcaactggaagggccgcgagctcaagtgcgggagcggcatcttcgtgacgaacgaggtgcacacctggaccgagcagtacaagttccaggccgactccccgaagcggctgagcgcggccatcggcaaggcctgggaggagggggtctgcggcatccgcagcgccacccggctggagaacatcatgtggaagcagatctccaacgagctcaaccacatcctgctggagaacgacatgaagttcaccgtggtggtcggggacgccaacggcatcctcgcgcaggggaagaagatgatccgcccccagcccatggagcacaagtacagctggaagtcctggggcaaggccaagatcatcggcgccgacatccagaacacgaccttcatcatcgacgggcccgacaccccggagtgccccgacggccagcgggcctggaacatctgggaggtggaggactacgggttcggcgtgttcaccacgaacatctggctgaagctgcgcgacagctacacccagatgtgcgaccaccggctcatgtccgcggccatcaaggacagcaaggccgtccacgccgacatgggctactggatcgagtccgagaagaacgagacctggaagctggcccgcgcgagcttcatcgaggtgaagacctgcacgtggcccaagtcccacaccctgtggagcaacggggtgctcgagtccgagatgatcatccccaagatctacggcgggccgatcagccagcacaactaccggcccggctacttcacccagaccgccgggccctggcacctgggcaagctggagctcgacttcgacctgtgcgagggcacgaccgtcgtggtggacgagcactgcgggaaccgcggcccgtccctgcggaccaccacggtcaccgggaagatcatccacgagtggtgctgccgcagctgcaccctgccgcccctgcggttccgcggcgaggacgggtgctggtacggcatggagatccggcccgtgaaggagaaggaggagaacctggtgcgctccatggtcagcgccggctccggggaggtggacagcttcagcctcggcatcctgtgcgtgtccatcatgatcgaggaggtcatgcggagccgctggtcccgcaagatgctgatgaccgggacgctcgccgtgttcctgctgctcatcatgggccagctgacctggaacgacctgatccggctctgcatcatggtgggggccaacgcgagcgaccgcatgggcatgggcaccacctacctggccctgatggccacgttcaagatgcggccgatgttcgccgtcgggctcctgttccgccggctgacctcccgcgaggtgctcctgctgaccatcggcctcagcctggtcgcctccgtggagctgcccaacagcctcgaggagctgggggacggcctggcgatgggcatcatgatgctcaagctgctgaccgagttccagccccaccagctctggacgaccctgctgtccctcaccttcgtgaagaccacgctgagcctggactacgcctggaagaccaccgccatggtcctctccatcgtgagcctgttccccctgtgcctctccaccacgagccagaagaccacctggctgccggtgctgctcgggtccttcggctgcaagcccctgaccatgttcctgatcaccgagaacaagatctgggggcgcaagagctggcccctcaacgagggcatcatggccatcgggatcgtctccatcctgctgagctccctcctgaagaacgacgtgcccctggcgggcccgctcatcgccggcgggatgctgatcgcctgctacgtgatcagcggcagctccgccgacctgagcctcgagaaggccgcggaggtctcctgggagcaggaggccgagcacagcggggcctcccacaacatcctggtggaggtgcaggacgacggcacgatgaagatcaaggacgaggagcgcgacgacaccctgaccatcctcctgaaggccaccctgctcgccgtcagcggggtgtaccccatgtccatccccgcgacgctgttcgtgtggtacttctggcagaagaagaagcagcggagcggcgtcctgtgggacaccccctccccgcccgaggtggagcgcgccgtgctcgacgacggcatctaccggatcctgcagcgcgggctgctgggccggagccaggtcggggtgggcgtgttccaggacggggtcttccacaccatgtggcacgtgacccgcggcgccgtgctcatgtaccagggcaagcggctggagccctcctgggccagcgtcaagaaggacctgatctcctacgggggcgggtggcgcttccagggcagctggaacacgggggaggaggtccaggtgatcgccgtcgagcccggcaagaacccgaagaacgtgcagaccacccccggcaccttcaagacgcccgagggggaggtgggcgcgatcgccctcgacttcaagcccgggacctccggcagcccgatcgtcaaccgggagggcaagatcgtggggctgtacggcaacggggtggtcaccacctccggcacgtacgtgagcgccatcgcccaggccaaggcgtcccaggaggggcccctgcccgagatcgaggacgaggtgttcaagaagcgcaacctcaccatcatggacctgcacccgggcagcggcaagacccggcgctacctgcccgccatcgtccgggaggccatcaagcgcaagctccgcaccctgatcctggcccccacgcgggtggtggcgagcgagatggccgaggccctcaaggggatgcccatccgctaccagaccaccgccgtcaagtccgagcacaccggccgggagatcgtggacctgatgtgccacgccacgttcaccatgcgcctgctcagcccggtgcgggtccccaactacaacatgatcatcatggacgaggcgcacttcaccgaccccgcctccatcgccgcccgcgggtacatcagcacccgggtgggcatgggggaggccgcggccatcttcatgacggccacgccgcccggctccgtggaggccttcccccagagcaacgccgtcatccaggacgaggagcgcgacatccccgagcggtcctggaacagcggctacgactggatcaccgacttccccgggaagaccgtgtggttcgtgccctccatcaagagcggcaacgacatcgcgaactgcctgcgcaagaacgggaagcgggtcatccagctgtcccgcaagacgttcgacaccgagtaccagaagaccaagaacaacgactgggactacgtggtgaccacggacatcagcgagatgggcgccaacttccgggccgaccgcgtcatcgacccccggcgctgcctcaagcccgtgatcctgaaggacgggcccgagcgggtcatcctggccggcccgatgcccgtgaccgtggcgtccgccgcccagcgccggggccgcatcgggcgcaaccagaacaaggagggcgaccagtacgtctacatggggcagcccctcaacaacgacgaggaccacgcccactggaccgaggccaagatgctgctggacaacatcaacacccccgagggcatcatcccggccctcttcgagcccgagcgggagaagtccgccgccatcgacggggagtaccgcctgcggggcgaggcccgcaagacgttcgtggagctgatgcggcgcggcgacctccccgtgtggctgtcctacaaggtcgccagcgaggggttccagtactccgaccggcgctggtgcttcgacggcgagcggaacaaccaggtgctggaggagaacatggacgtggagatctggaccaaggagggggagcgcaagaagctccggccccgctggctggacgcgcggacctacagcgacccgctggccctccgcgagttcaaggagttcgccgccggccggcgctccgtcagcggcgacctgatcctggagatcgggaagctcccccagcacctgaccctgcgggcccagaacgcgctcgacaacctggtgatgctgcacaacagcgagcagggcgggaaggcctaccgccacgccatggaggagctccccgacaccatcgagacgctgatgctgctcgccctgatcgcggtgctgaccggcggggtcaccctcttcttcctgtccggcaagggcctggggaagaccagcatcggcctcctgtgcgtgacggcctccagcgccctgctctggatggcctccgtggagccccactggatcgccgcgagcatcatcctggagttcttcctgatggtcctcctgatcccggagcccgaccggcagcgcacgccccaggacaaccagctggcctacgtggtgatcgggctcctgttcatgatcctgaccgtcgccgccaacgagatgggcctcctggagaccacgaagaaggacctggggatcggctacgtggccgcggagaaccaccagcacgccaccatgctcgacgtggacctgcacccggcctccgcctggaccctgtacgccgtcgcgaccacggtgatcacccccatgatgcggcacaccatcgagaacaccacggccaacatcagcctcaccgccatcgccaaccaggccgcgatcctgatgggcctggacaaggggtggcccatctccaagatggacatcggcgtgcccctcctggccctggggtgctacagccaggtcaacccgctcaccctgaccgccgccgtgctgatgctcgtggcgcactacgccatcatcggccccgggctgcaggccaaggccacgcgcgaggcccagaagcgcaccgcggccggcatcatgaagaaccccaccgtcgacggcatcgtggccatcgacctggaccccgtggtctacgacgccaagttcgagaagcagctcgggcagatcatgctgctgatcctctgcacctcccagatcctgctgatgcggacgacctgggccctctgcgagagcatcaccctggcgaccggcccgctgacgaccctctgggaggggtcccccggcaagttctggaacaccaccatcgccgtgagcatggccaacatcttccgcggctcctacctggccggggccggcctggcgttcagcctcatgaagtccctcgggggcgggcggcgcggcacgggcgcccagggggagaccctgggcgagaagtggaagcggcagctcaaccagctgagcaagtccgagttcaacacctacaagcgcagcgggatcatggaggtggaccggagcgaggccaaggagggcctgaagcgcggggagaccacgaagcacgccgtctcccggggcaccgcgaagctccgctggttcgtggagcggaacctggtgaagcccgagggcaaggtcatcgacctggggtgcggccgcgggggctggagctactactgcgccgggctgaagaaggtgaccgaggtgaagggctacaccaagggcgggcccggccacgaggagccgatccccatggccacctacgggtggaacctcgtcaagctgcactccggcaaggacgtgttcttcatgccgcccgagaagtgcgacacgctgctctgcgacatcggggagagctccccgaaccccaccatcgaggagggccggaccctgcgcgtgctgaagatggtcgagccctggctccggggcaaccagttctgcatcaagatcctgaacccctacatgccgagcgtggtggagaccctggagcagatgcagcgcaagcacgggggcatgctcgtccggaaccccctgtcccgcaacagcacgcacgagatgtactgggtgtcctgcgggaccggcaacatcgtgagcgccgtcaacatgacctcccggatgctgctcaaccgcttcaccatggcccaccgcaagcccacgtacgagcgggacgtggacctgggcgcggggacccgccacgtggccgtcgagcccgaggtggccaacctggacatcatcggccagcggatcgagaacatcaagaacgagcacaagagcacctggcactacgacgaggacaacccgtacaagacctgggcctaccacgggtcctacgaggtcaagcccagcggctccgccagctccatggtgaacggggtggtccgcctcctgacgaagccctgggacgtgatccccatggtgacccagatcgcgatgaccgacaccacgccgttcggccagcagcgggtcttcaaggagaaggtggacacccgcacgccccgggccaagcgcggcaccacgcagatcatggaggtgaccgccaagtggctgtgggggttcctcagccggaacaagaagccccgcatctgcacccgggaggagttcacccgcaaggtccggtccaacgccgccatcggcgcggtgttcgtggacgagaaccagtggaacagcgccaaggaggccgtcgaggacgagcgcttctgggacctggtgcaccgggagcgcgagctgcacaagcaggggaagtgcgccacgtgcgtgtacaacatgatgggcaagcgggagaagaagctcggggagttcggcaaggcgaagggcagccgcgccatctggtacatgtggctgggggcccggttcctggagttcgaggccctcggcttcatgaacgaggaccactggttctcccgcgagaacagcctgtccggggtcgagggcgaggggctgcacaagctcggctacatcctgcgggacatcagcaagatcccgggcgggaacatgtacgccgacgacaccgcgggctgggacacccgcatcaccgaggacgacctgcagaacgaggccaagatcacggacatcatggagcccgagcacgccctcctggccacctccatcttcaagctgacctaccagaacaaggtggtgcgcgtccagcggcccgccaagaacgggaccgtgatggacgtgatcagccgccgggaccagcgcggctccggccaggtcgggacgtacggcctcaacaccttcaccaacatggaggtgcagctgatccggcagatggagagcgaggggatcttcctgccctccgagctcgagaccccgaacctggcggagcgcgccctggactggctcgagaagcacggcgccgagcggctgaagcgcatggccatcagcggggacgactgcgtggtcaagcccatcgacgaccggttcgccacggcgctgaccgccctcaacgacatgggcaaggtgcgcaaggacatcccccagtgggagccctccaagggctggaacgactggcagcaggtcccgttctgcagccaccacttccaccagctgatcatgaaggacgggcgggagatcgtcgtgccctgccgcaaccaggacgagctggtgggccgggcccgcgtctcccagggggccggctggagcctccgggagaccgcctgcctggggaagtcctacgcgcagatgtggcagctgatgtacttccaccgccgggacctccgcctggccgccaacgccatctgcagcgcggtgcccgtggactgggtccccacctcccggaccacgtggagcatccacgcccaccaccagtggatgaccaccgaggacatgctgagcgtgtggaaccgcgtgtggatcgaggagaacccgtggatggaggacaagacccacgtctccagctgggaggaggtgccctacctcggcaagcgcgaggaccagtggtgcggctccctgatcgggctgacggcccgggccacctgggccaccaacatccaggtggcgatcaaccaggtccgccggctcatcggcaacgagaactacctggactacatgaccagcatgaagcgcttcaagaacgagtccgaccccgagggggccctgtggtga

SEQ ID NO: 8248 - RNA, 9879 nt, synthetic construct
  misc_feature 1..9879: note = derived and/or modified CDS sequence (opt1) from DENV-1__FJ639814__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcgcgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctgtggtccaacggggtgctcgagagcgagatgatcatccccaagatctacggcgggccgatctcccagcacaactaccggcccggctacttcacccagaccgccgggccctggcacctgggcaagctggagctcgacttcaacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgtgagcatcatgatcgaggaggtgatgcggtcccgctggagccgcaagatgctgatgaccgggacgctcgccgtcttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtggggctcctgttccgccggctgaccagccgcgaggtcctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatggtgctcagcatcgtctccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggccatcgggatcgtgagcatcctgctgtccagcctcctgaagaacgacgtccccctggcgggcccgctcatcgccggcgggatgctgatcgcctgctacgtgatcagcggctccagcgccgacctgtccctcgagaaggccgcggaggtgagctgggagcaggaggccgagcactccggggccagccacaacatcctggtcgaggtgcaggacgacggcacgatgaagatcaaggacgaggagcgcgacgacaccctgaccatcctcctgaaggccaccctgctcgccgtgtccggggtctaccccatgagcatccccgcgacgctgttcgtgtggtacttctggcagaagaagaagcagcggtccggcgtgctgtgggacacccccagcccgcccgaggtcgagcgcgccgtgctcgacgacggcatctaccggatcctgcagcgcgggctgctgggccggtcccaggtgggggtcggcgtgttccaggacggggtgttccacaccatgtggcacgtcacccgcggcgccgtgctcatgtaccagggcaagcggctggagcccagctgggcctccgtgaagaaggacctgatcagctacgggggcgggtggcgcttccagggctcctggaacacgggggaggaggtccaggtgatcgccgtggagcccggcaagaacccgaagaacgtccagaccacccccggcaccttcaagacgcccgagggggaggtgggcgcgatcgccctcgacttcaagcccgggaccagcggctccccgatcgtgaaccgggagggcaagatcgtcgggctgtacggcaacggggtggtgaccaccagcggcacgtacgtctccgccatcgcccaggccaaggcgagccaggaggggcccctgcccgagatcgaggacgaggtgttcaagaagcgcaacctcaccatcatggacctgcacccgggcagcggcaagacccggcgctacctgcccgccatcgtgcgggaggccatcaagcgcaagctccgcaccctgatcctggcccccacgcgggtcgtggcgtccgagatggccgaggccctcaaggggatgcccatccgctaccagaccaccgccgtcaagagcgagcacaccggccgggagatcgtcgacctgatgtgccacgccacgttcaccatgcgcctgctctccccggtgcgggtgcccaactacaacatgatcatcatggacgaggcgcacttcaccgaccccgccagcatcgccgcccgcgggtacatctccacccgggtcggcatgggggaggccgcggccatcttcatgacggccacgccgcccggcagcgtggaggccttcccccagtccaacgccgtgatccaggacgaggagcgcgacatccccgagcggagctggaactccggctacgactggatcaccgacttccccgggaagaccgtctggttcgtgcccagcatcaagtccggcaacgacatcgcgaactgcctgcgcaagaacgggaagcgggtgatccagctgagccgcaagacgttcgacaccgagtaccagaagaccaagaacaacgactgggactacgtcgtgaccacggacatctccgagatgggcgccaacttccgggccgaccgcgtgatcgacccccggcgctgcctcaagcccgtcatcctgaaggacgggcccgagcgggtgatcctggccggcccgatgcccgtcaccgtggcgagcgccgcccagcgccggggccgcatcgggcgcaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgggagaagtccgccgccatcgacggggagtaccgcctgcggggcgaggcccgcaagacgttcgtcgagctgatgcggcgcggcgacctccccgtgtggctgagctacaaggtggcctccgaggggttccagtacagcgaccggcgctggtgcttcgacggcgagcggaacaaccaggtcctggaggagaacatggacgtggagatctggaccaaggagggggagcgcaagaagctccggccccgctggctggacgcgcggacctactccgacccgctggccctccgcgagttcaaggagttcgccgccggccggcgcagcgtgagcggcgacctgatcctggagatcgggaagctcccccagcacctgaccctgcgggcccagaacgcgctcgacaacctggtcatgctgcacaactccgagcagggcgggaaggcctaccgccacgccatggaggagctccccgacaccatcgagacgctgatgctgctcgccctgatcgcggtgctgaccggcggggtgaccctcttcttcctgagcggcaagggcctggggaagacctccatcggcctcctgtgcgtcacggccagctccgccctgctctggatggccagcgtggagccccactggatcgccgcgtccatcatcctggagttcttcctgatggtgctcctgatcccggagcccgaccggcagcgcacgccccaggacaaccagctggcctacgtcgtgatcgggctcctgttcatgatcctgaccgtggccgccaacgagatgggcctcctggagaccacgaagaaggacctggggatcggctacgtcgccgcggagaaccaccagcacgccaccatgctcgacgtggacctgcacccggccagcgcctggaccctgtacgccgtggcgaccacggtcatcacccccatgatgcggcacaccatcgagaacaccacggccaacatctccctcaccgccatcgccaaccaggccgcgatcctgatgggcctggacaaggggtggcccatcagcaagatggacatcggcgtgcccctcctggccctggggtgctactcccaggtgaacccgctcaccctgaccgccgccgtcctgatgctcgtggcgcactacgccatcatcggccccgggctgcaggccaaggccacgcgcgaggcccagaagcgcaccgcggccggcatcatgaagaaccccaccgtggacggcatcgtcgccatcgacctggaccccgtggtgtacgacgccaagttcgagaagcagctcgggcagatcatgctgctgatcctctgcaccagccagatcctgctgatgcggacgacctgggccctctgcgagtccatcaccctggcgaccggcccgctgacgaccctctgggaggggagccccggcaagttctggaacaccaccatcgccgtctccatggccaacatcttccgcggcagctacctggccggggccggcctggcgttctccctcatgaagtccctcgggggcgggcggcgcgggacgggcgcccagggggagaccctgggcgagaagtggaagcggcagctcaaccagctgtccaagagcgagttcaacacctacaagcgcagcgggatcatggaggtggaccggtccgaggccaaggagggcctgaagcgcggggagaccacgaagcacgccgtgagccggggcaccgcgaagctccgctggttcgtcgagcggaacctggtgaagcccgagggcaaggtgatcgacctggggtgcggccgcgggggctggtcctactactgcgccgggctgaagaaggtcaccgaggtgaagggctacaccaagggcgggcccggccacgaggagccgatccccatggccacctacgggtggaacctcgtgaagctgcacagcggcaaggacgtcttcttcatgccgcccgagaagtgcgacacgctgctctgcgacatcggggagtccagcccgaaccccaccatcgaggagggccggaccctgcgcgtgctgaagatggtggagccctggctccggggcaaccagttctgcatcaagatcctgaacccctacatgccgtccgtcgtggagaccctggagcagatgcagcgcaagcacgggggcatgctcgtgcggaaccccctgagccgcaactccacgcacgagatgtactgggtcagctgcgggaccggcaacatcgtgtccgccgtgaacatgaccagccggatgctgctcaaccgcttcaccatggcccaccgcaagcccacgtacgagcgggacgtcgacctgggcgcggggacccgccacgtggccgtggagcccgaggtcgccaacctggacatcatcggccagcggatcgagaacatcaagaacgagcacaagtccacctggcactacgacgaggacaacccgtacaagacctgggcctaccacgggagctacgaggtgaagccctccggcagcgcctccagcatggtcaacggggtggtgcgcctcctgacgaagccctgggacgtcatccccatggtgacccagatcgcgatgaccgacaccacgccgttcggccagcagcgggtgttcaaggagaaggtcgacacccgcacgccccgggccaagcgcggcaccacgcagatcatggaggtgaccgccaagtggctgtgggggttcctctcccggaacaagaagccccgcatctgcacccgggaggagttcacccgcaaggtgcggagcaacgccgccatcggcgcggtcttcgtggacgagaaccagtggaacagcgccaaggaggccgtggaggacgagcgcttctgggacctggtccaccgggagcgcgagctgcacaagcaggggaagtgcgccacgtgcgtgtacaacatgatgggcaagcgggagaagaagctcggggagttcggcaaggcgaagggctcccgcgccatctggtacatgtggctgggggcccggttcctggagttcgaggccctcggcttcatgaacgaggaccactggttcagccgcgagaactccctgagcggggtggagggcgaggggctgcacaagctcggctacatcctgcgggacatctccaagatcccgggcgggaacatgtacgccgacgacaccgcgggctgggacacccgcatcaccgaggacgacctgcagaacgaggccaagatcacggacatcatggagcccgagcacgccctcctggccaccagcatcttcaagctgacctaccagaacaaggtcgtgcgcgtgcagcggcccgccaagaacgggaccgtcatggacgtgatctcccgccgggaccagcgcggcagcggccaggtggggacgtacggcctcaacaccttcaccaacatggaggtccagctgatccggcagatggagtccgaggggatcttcctgcccagcgagctcgagaccccgaacctggcggagcgcgccctggactggctcgagaagcacggcgccgagcggctgaagcgcatggccatctccggggacgactgcgtggtgaagcccatcgacgaccggttcgccacggcgctgaccgccctcaacgacatgggcaaggtccgcaaggacatcccccagtgggagcccagcaagggctggaacgactggcagcaggtcccgttctgctcccaccacttccaccagctgatcatgaaggacgggcgggagatcgtggtcccctgccgcaaccaggacgagctggtgggccgggcccgcgtgagccagggggccggctggtccctccgggagaccgcctgcctgggcaagagctacgcgcagatgtggcagctgatgtacttccaccgccgggacctccgcctggccgccaacgccatctgctccgcggtccccgtggactgggtgcccaccagccggaccacgtggagcatccacgcccaccaccagtggatgaccaccgaggacatgctgtccgtctggaaccgcgtgtggatcgaggagaacccgtggatggaggacaagacccacgtgagctcctgggaggaggtcccctacctcggcaagcgcgaggaccagtggtgcggcagcctgatcgggctgacggcccgggccacctgggccaccaacatccaggtggcgatcaaccaggtgcgccggctcatcggcaacgagaactacctggactacatgacctccatgaagcgcttcaagaacgagagcgaccccgagggggccctgtggtga

SEQ ID NO: 8249 - RNA, 9879 nt, synthetic construct
  misc_feature 1..9879: note = derived and/or modified CDS sequence (opt1) from DENV-1__FJ639815__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctgtggtccaacggggtgctcgagagcgagatgatcatccccaagatctacggcgggccgatctcccagcacaactaccggcccggctacttcacccagaccgccgggccctggcacctgggcaagctggagctcgacttcgacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgtgagcatcatgatcgaggaggtgatgcggtcccgctggagccgcaagatgctgatgaccgggacgctcgccgtcttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtggggctcctgttccgccggctgaccagccgcgaggtcctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatgctcctgagcatcgtgtccctgttccccctctgcctgagcaccacgtcccagaagaccacctggctgccggtcctcctggggagcttcggctgcaagcccctgaccatgttcctcatcaccgagaacaagatctgggggcggaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcacgatgaagatcaaggacgaggagcgcgacgacaccctcaccatcctgctgaaggccaccctcctggccgtgtccggggtgtaccccatgagcatccccgcgacgctgttcgtctggtacttctggcagaagaagaagcagcggtccggcgtgctctgggacacccccagcccgcccgaggtggagcgcgccgtcctggacgacggcatctaccggatcctgcagcgcgggctgctcggccggtcccaggtgggggtgggcgtcttccaggacggggtgttccacaccatgtggcacgtgacccgcggcgccgtcctgatgtaccagggcaagcggctggagcccagctgggcctccgtgaagaaggacctcatcagctacgggggcgggtggcgcttccagggctcctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggaccagcggctccccgatcgtgaaccgggagggcaagatcgtggggctgtacggcaacggggtcgtgaccaccagcggcacgtacgtgtccgccatcgcccaggccaaggcgagccaggaggggcccctccccgagatcgaggacgaggtcttcaagaagcgcaacctgaccatcatggacctgcacccgggcagcggcaagacccggcgctacctccccgccatcgtgcgggaggccatcaagcgcaagctgcgcaccctgatcctcgcccccacgcgggtggtcgcgtccgagatggccgaggccctgaaggggatgcccatccgctaccagaccaccgccgtcaagagcgagcacaccggccgggagatcgtggacctgatgtgccacgccacgttcaccatgcgcctcctgtccccggtccgggtgcccaactacaacatgatcatcatggacgaggcgcacttcaccgaccccgccagcatcgccgcccgcgggtacatctccacccgggtgggcatgggggaggccgcggccatcttcatgacggccacgccgcccggcagcgtcgaggccttcccccagtccaacgccgtgatccaggacgaggagcgcgacatccccgagcggagctggaactccggctacgactggatcaccgacttccccgggaagaccgtgtggttcgtccccagcatcaagtccggcaacgacatcgcgaactgcctgcgcaagaacgggaagcgggtgatccagctcagccgcaagacgttcgacaccgagtaccagaagaccaagaacaacgactgggactacgtggtcaccacggacatctccgagatgggcgccaacttccgggccgaccgcgtgatcgacccccggcgctgcctgaagcccgtgatcctgaaggacgggcccgagcgggtcatcctcgccggcccgatgcccgtgaccgtcgcgagcgccgcccagcgccggggccgcatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgggagaagtccgccgccatcgacggggagtaccgcctgcggggcgaggcccgcaagacgttcgtggagctcatgcggcgcggcgacctgcccgtctggctgagctacaaggtggcctccgaggggttccagtacagcgaccggcgctggtgcttcgacggcgagcggaacaaccaggtgctcgaggagaacatggacgtcgagatctggaccaaggagggggagcgcaagaagctgcggccccgctggctggacgcgcggacctactccgacccgctcgccctgcgcgagttcaaggagttcgccgccggccggcgcagcgtgagcggcgacctgatcctcgagatcgggaagctgccccagcacctgaccctccgggcccagaacgcgctggacaacctggtgatgctccacaactccgagcagggcgggaaggcctaccgccacgccatggaggagctgcccgacaccatcgagacgctgatgctcctggccctgatcgcggtcctcaccggcggggtgaccctgttcttcctgagcggcaagggcctcgggaagacctccatcggcctgctgtgcgtgacggccagctccgccctcctgtggatggccagcgtcgagccccactggatcgccgcgtccatcatcctggagttcttcctcatggtgctgctgatcccggagcccgaccggcagcgcacgccccaggacaaccagctcgcctacgtggtcatcgggctgctgttcatgatcctcaccgtggccgccaacgagatgggcctgctggagaccacgaagaaggacctcgggatcggctacgtggccgcggagaaccaccagcacgccaccatgctggacgtcgacctgcacccggccagcgcctggaccctctacgccgtggcgaccacggtgatcacccccatgatgcggcacaccatcgagaacaccacggccaacatctccctgaccgccatcgccaaccaggccgcgatcctgatgggcctcgacaaggggtggcccatcagcaagatggacatcggcgtccccctgctggccctcgggtgctactcccaggtgaacccgctgaccctgaccgccgccgtgctcatgctggtcgcgcactacgccatcatcggccccgggctgcaggccaaggccacgcgcgaggcccagaagcgcaccgcggccggcatcatgaagaaccccaccgtggacggcatcgtggccatcgacctcgaccccgtcgtgtacgacgccaagttcgagaagcagctggggcagatcatgctgctcatcctgtgcaccagccagatcctgctcatgcggacgacctgggccctgtgcgagtccatcaccctggcgaccggcccgctcacgaccctgtgggaggggagccccggcaagttctggaacaccaccatcgccgtgtccatggccaacatcttccgcggcagctacctggccggggccggcctcgcgttctccctgatgaagtccctcgggggcgggcggcgcgggacgggcgcccagggggagaccctcggcgagaagtggaagcggcagctgaaccagctgtccaagagcgagttcaacacctacaagcgcagcgggatcatggaggtcgaccggtccgaggccaaggagggcctcaagcgcggggagaccacgaagcacgccgtgagccggggcaccgcgaagctgcgctggttcgtggagcggaacctggtcaagcccgagggcaaggtgatcgacctggggtgcggccgcgggggctggtcctactactgcgccgggctcaagaaggtgaccgaggtcaagggctacaccaagggcgggcccggccacgaggagccgatccccatggccacctacgggtggaacctggtgaagctgcacagcggcaaggacgtgttcttcatgccgcccgagaagtgcgacacgctcctgtgcgacatcggggagtccagcccgaaccccaccatcgaggagggccggaccctgcgcgtcctcaagatggtggagccctggctgcggggcaaccagttctgcatcaagatcctgaacccctacatgccgtccgtggtcgagaccctcgagcagatgcagcgcaagcacgggggcatgctggtgcggaaccccctgagccgcaactccacgcacgagatgtactgggtgagctgcgggaccggcaacatcgtctccgccgtgaacatgaccagccggatgctcctgaaccgcttcaccatggcccaccgcaagcccacgtacgagcgggacgtggacctgggcgcggggacccgccacgtcgccgtggagcccgaggtggccaacctcgacatcatcggccagcggatcgagaacatcaagaacgagcacaagtccacctggcactacgacgaggacaacccgtacaagacctgggcctaccacgggagctacgaggtcaagccctccggcagcgcctccagcatggtgaacggggtcgtgcgcctgctgacgaagccctgggacgtgatccccatggtcacccagatcgcgatgaccgacaccacgccgttcggccagcagcgggtgttcaaggagaaggtggacacccgcacgccccgggccaagcgcggcaccacgcagatcatggaggtcaccgccaagtggctctgggggttcctgtcccggaacaagaagccccgcatctgcacccgggaggagttcacccgcaaggtgcggagcaacgccgccatcggcgcggtgttcgtcgacgagaaccagtggaacagcgccaaggaggccgtggaggacgagcgcttctgggacctggtgcaccgggagcgcgagctccacaagcaggggaagtgcgccacgtgcgtctacaacatgatgggcaagcgggagaagaagctgggggagttcggcaaggcgaagggctcccgcgccatctggtacatgtggctgggggcccggttcctcgagttcgaggccctgggcttcatgaacgaggaccactggttcagccgcgagaactccctgagcggggtggagggcgaggggctccacaagctgggctacatcctgcgggacatctccaagatcccgggcgggaacatgtacgccgacgacaccgcgggctgggacacccgcatcaccgaggacgacctccagaacgaggccaagatcacggacatcatggagcccgagcacgccctgctggccaccagcatcttcaagctcacctaccagaacaaggtggtccgcgtgcagcggcccgccaagaacgggaccgtgatggacgtcatctcccgccgggaccagcgcggcagcggccaggtggggacgtacggcctgaacaccttcaccaacatggaggtgcagctgatccggcagatggagtccgaggggatcttcctccccagcgagctggagaccccgaacctggcggagcgcgccctcgactggctggagaagcacggcgccgagcggctgaagcgcatggccatctccggggacgactgcgtcgtgaagcccatcgacgaccggttcgccacggcgctcaccgccctgaacgacatgggcaaggtgcgcaaggacatcccccagtgggagcccagcaagggctggaacgactggcagcaggtcccgttctgctcccaccacttccaccagctgatcatgaaggacgggcgggagatcgtggtgccctgccgcaaccaggacgagctcgtcggccgggcccgcgtgagccagggggccggctggtccctgcgggagaccgcctgcctgggcaagagctacgcgcagatgtggcagctcatgtacttccaccgccgggacctgcgcctggccgccaacgccatctgctccgcggtgcccgtcgactgggtgcccaccagccggaccacgtggagcatccacgcccaccaccagtggatgaccaccgaggacatgctctccgtgtggaaccgcgtctggatcgaggagaacccgtggatggaggacaagacccacgtgagctcctgggaggaggtgccctacctgggcaagcgcgaggaccagtggtgcggcagcctgatcgggctcacggcccgggccacctgggccaccaacatccaggtcgcgatcaaccaggtgcgccggctgatcggcaacgagaactacctggactacatgacctccatgaagcgcttcaagaacgagagcgaccccgagggggccctctggtga

SEQ ID NO: 8250 - RNA, 9879 nt, synthetic construct
  misc_feature 1..9879: note = derived and/or modified CDS sequence (opt1) from DENV-1__FJ639818__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacaccaccgacacctgggtgacctacgggacctgcagccagacgggcgagcaccggcgcgacaagcggtccgtggccctggcgccccacgtgggcctggggctcgagacccgcaccgagacctggatgagctccgagggcgcgtggaagcagatccagcgggtcgagacgtgggccctgcgccaccccgggttcaccgtgatcgccctgttcctcgcccacgcgatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgccgtgctccggaagctgtgcatcgaggcgaagatcagcaacaccacgaccgactcccgctgcccgacccagggcgaggccaccctggtggaggagcaggacgccaacttcgtctgccggcgcacgttcgtggaccggggctgggggaacggctgcggcctcttcggcaaggggagcctgctgacctgcgccaagttcaagtgcgtgaccaagctcgagggcaagatcgtccagtacgagaacctgaagtactccgtgatcgtgaccgtccacacgggcgaccagcaccaggtggggaacgagaccaccgagcacggcaccatcgccaccatcacgccccaggcgcccaccagcgagatccagctgaccgactacggggccctcaccctggactgcagcccccgcacgggcctggacttcaacgagatggtcctcctgaccatgaaggagaagtcctggctggtgcacaagcagtggttcctcgacctgccgctgccctggacctccggggccagcaccagccaggagacgtggaaccggcaggacctcctggtgaccttcaagaccgcccacgccaagaagcaggaggtcgtggtgctgggctcccaggagggcgcgatgcacaccgccctcacgggggccaccgagatccagaccagcggcaccacgaccatcttcgccgggcacctgaagtgccgcctgaagatggagaagctcaccctgaagggcatgtcctacgtcatgtgcaccgggagcttcaagctggagaaggaggtggccgagacgcagcacggcaccgtgctggtccaggtgaagtacgagggcaccgacgcgccctgcaagatccccttctccacccaggacgagaagggggtgacgcagaacggccggctcatcaccgccaacccgatcgtcaccgacaaggagaagcccgtgaacatcgagaccgagccgcccttcggggagagctacatcgtggtcggcgccggcgagaaggccctgaagctgtcctggttcaagaaggggagctccatcggcaagatgttcgaggcgacggcccgcggggcccggcgcatggccatcctcggcgacaccgcctgggacttcgggagcatcggcggcgtgttcacctccgtggggaagctggtccaccaggtgttcggcaccgcgtacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgccgcgatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgccaacggcatcctggcccaggggaagaagatgatccggccccagcccatggagcacaagtactcctggaagtcctggggcaaggcgaagatcatcggcgccgacatccagaacaccaccttcatcatcgacgggcccgacaccccggagtgccccgacggccagcgcgcctggaacatctgggaggtcgaggactacgggttcggcatcttcacgaccaacatctggctgaagctccgggactcctacacccagatgtgcgaccaccgcctgatgagcgccgcgatcaaggactccaaggccgtgcacgccgacatgggctactggatcgagagcgagaagaacgagacctggaagctggcccgggcctccttcatcgaggtgaagacgtgcacctggcccaagagccacaccctctggtccaacggggtcctggagagcgagatgatcatccccaagatctacggcgggccgatctcccagcacaactaccgccccggctacttcacccagacggcggggccctggcacctgggcaagctcgagctggacttcgacctgtgcgagggcaccaccgtggtggtcgacgagcactgcgggaaccggggcccgagcctccgcaccacgaccgtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgacggggaccctggccgtgttcctgctcctgatcatgggccagctgacctggaacgacctcatccgcctgtgcatcatggtcggggccaacgcctccgaccggatgggcatgggcaccacgcacctggccctcatggccaccttcaagatgcgcccgatgttcgccgtggggctgctgttccggcgcctcaccagccgggaggtgctgctgctcaccatcgggctgtccctggtcgccagcgtggagctccccaactccctggaggagctgggggacggcctcgccatgggcatcatgatgctgaagctgctcacggagttccagccccaccagctgtggaccaccctgctcagcctgaccttcgtcaagacgaccctgtccctcgactacgcgtggaagaccaccgccatggtgctgagcatcgtgtccctgttccccctctgcctgagcacgacctcccagaagaccacctggctgccggtcctcctggggagcttcggctgcaagcccctgaccatgttcctcatcacggagaacaagatctgggggcgcaagtcctggcccctgaacgagggcatcatggccatcgggatcgtgagcatcctgctctccagcctgctgaagaacgacgtgcccctcgccggcccgctgatcgcgggcgggatgctgatcgcctgctacgtcatcagcggctccagcgccgacctctccctggagaaggccgccgaggtgagctgggagcaggaggcggagcactccggggccagccacaacatcctggtggaggtccaggacgacggcaccatgaagatcaaggacgaggagcgggacgacaccctcaccatcctgctgaaggccacgctcctggccgtgtccggggtgtaccccatgagcatccccgccaccctgttcgtctggtacttctggcagaagaagaagcagcgctccggcgtgctctgggacacccccagcccgcccgaggtggagcgggcggtcctggacgacggcatctaccgcatcctgcagcgggggctgctcggccgctcccaggtgggggtgggcgtcttccaggacggggtgttccacaccatgtggcacgtgacgcggggcgccgtcctgatgtaccagggcaagcgcctggagcccagctgggcctccgtgaagaaggacctcatcagctacgggggcgggtggcggttccagggctcctggaacaccggggaggaggtgcaggtcatcgccgtggagcccggcaagaacccgaagaacgtgcagaccacccccggcacgttcaagacccccgagggggaggtcggcgccatcgcgctggacttcaagcccgggaccagcggctccccgatcgtgaaccgcgagggcaagatcgtggggctgtacggcaacggggtcgtgaccacgagcggcacctacgtgtccgccatcgcccaggccaaggccagccaggaggggcccctccccgagatcgaggacgaggtcttcaagaagcggaacctgaccatcatggacctgcacccgggcagcggcaagacccgccggtacctccccgcgatcgtgcgcgaggccatcaagcggaagctgcgcacgctgatcctcgcccccacccgcgtggtcgcctccgagatggcggaggccctgaaggggatgcccatccggtaccagaccaccgccgtcaagagcgagcacacgggccgcgagatcgtggacctgatgtgccacgccaccttcaccatgcggctcctgtccccggtccgcgtgcccaactacaacatgatcatcatggacgaggcccacttcaccgaccccgcgagcatcgccgcccgggggtacatctccacgcgcgtgggcatgggggaggccgccgcgatcttcatgaccgccacgccgcccggcagcgtcgaggccttcccccagtccaacgccgtgatccaggacgaggagcgggacatccccgagcgcagctggaactccggctacgactggatcaccgacttccccgggaagacggtgtggttcgtccccagcatcaagtccggcaacgacatcgccaactgcctgcggaagaacgggaagcgcgtgatccagctcagccggaagaccttcgacaccgagtaccagaagaccaagaacaacgactgggactacgtggtcacgaccgacatctccgagatgggcgcgaacttccgcgccgaccgggtgatcgacccccgccggtgcctgaagcccgtgatcctgaaggacgggcccgagcgcgtcatcctcgccggcccgatgcccgtgaccgtcgccagcgcggcccagcggcgcggccggatcgggcgcaaccagaacaaggagggcgaccagtacgtgtacatggggcagcccctgaacaacgacgaggaccacgcccactggaccgaggccaagatgctgctcgacaacatcaacacgcccgagggcatcatcccggccctgttcgagcccgagcgcgagaagtccgcggccatcgacggggagtaccggctgcgcggcgaggcccggaagaccttcgtggagctcatgcgccggggcgacctgcccgtctggctgagctacaaggtggcctccgaggggttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacctactccgacccgctcgcgctgcgggagttcaaggagttcgccgccggccgccggagcgtgagcggcgacctgatcctcgagatcgggaagctgccccagcacctgaccctccgcgcccagaacgccctggacaacctggtgatgctccacaactccgagcagggcgggaaggcgtaccggcacgccatggaggagctgcccgacacgatcgagaccctgatgctcctggccctgatcgccgtcctcaccggcggggtgaccctgttcttcctgagcggcaagggcctcgggaagacgtccatcggcctgctgtgcgtgaccgcgagctccgccctcctgtggatggccagcgtcgagccccactggatcgccgcctccatcatcctggagttcttcctcatggtgctgctgatcccggagcccgaccgccagcggacgccccaggacaaccagctcgcgtacgtggtcatcgggctgctgttcatgatcctcaccgtggccgccaacgagatgggcctgctggagacgaccaagaaggacctcgggatcggctacgtggccgccgagaaccaccagcacgcgaccatgctggacgtcgacctgcgcccggccagcgcctggaccctctacgccgtggccacgaccgtgatcacccccatgatgcggcacaccatcgagaacacgaccgcgaacatctccctgaccgccatcgccaaccaggccgccatcctgatgggcctcgacaaggggtggcccatcagcaagatggacatcggcgtccccctgctggcgctcgggtgctactcccaggtgaacccgctgaccctgacggccgccgtgctcatgctggtcgcccactacgcgatcatcggccccgggctgcaggccaaggccacccgcgaggcccagaagcgcaccgccgcgggcatcatgaagaaccccaccgtggacggcatcgtggccatcgacctcgaccccgtcgtgtacgacgccaagttcgagaagcagctggggcagatcatgctgctcatcctgtgcacgagccagatcctgctcatgcggaccacctgggccctgtgcgagtccatcaccctggccacgggcccgctcaccaccctgtgggaggggagccccggcaagttctggaacaccacgatcgcggtgtccatggccaacatcttccgcggcagctacctggccggggccggcctcgccttctccctgatgaagtccctcgggggcgggcggcgcgggaccggcgcgcagggggagaccctcggcgagaagtggaagcggcagctgaaccagctgtccaagagcgagttcaacacctacaagcgcagcgggatcatggaggtcgaccggtccgaggccaaggagggcctcaagcgcggggagacgaccaagcacgccgtgagccggggcaccgccaagctgcgctggttcgtggagcggaacctggtcaagcccgagggcaaggtgatcgacctggggtgcggccgcgggggctggtcctactactgcgcggggctcaagaaggtgaccgaggtcaagggctacaccaagggcgggcccggccacgaggagccgatccccatggccacgtacgggtggaacctggtgaagctgcacagcggcaaggacgtgttcttcatgccgcccgagaagtgcgacaccctcctgtgcgacatcggggagtccagcccgaaccccaccatcgaggagggccggaccctgcgcgtcctcaagatggtggagccctggctgaagggcaaccagttctgcatcaagatcctgaacccctacatgccgtccgtggtcgagacgctcgagcagatgcagcggaagcacgggggcatgctggtgcgcaaccccctgagccggaactccacccacgagatgtactgggtgagctgcgggaccggcaacatcgtctccgccgtgaacatgaccagccgcatgctcctgaaccggttcacgatggcccaccgcaagcccacctacgagcgcgacgtggacctgggcgccgggacccggcacgtcgcggtggagcccgaggtggccaacctcgacatcatcggccagcgcatcgagaacatcaagaacgagcacaagtccacctggcactacgacgaggacaacccgtacaagacgtgggcctaccacgggagctacgaggtcaagccctccggcagcgcctccagcatggtgaacggggtcgtgcggctgctgaccaagccctgggacgtgatccccatggtcacccagatcgccatgaccgacacgaccccgttcggccagcagcgcgtgttcaaggagaaggtggacacccggacgccccgcgcgaagcggggcacgacccagatcatggaggtcaccgccaagtggctctgggggttcctgtcccgcaacaagaagccccggatctgcacccgcgaggagttcacgcggaaggtgcgcagcaacgccgccatcggcgccgtgttcgtcgacgagaaccagtggaacagcgcgaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaagggctcccgggcgatctggtacatgtggctgggggcccgcttcctcgagttcgaggccctgggcttcatgaacgaggaccactggttcagccgggagaactccctgagcggggtggagggcgaggggctccacaagctgggctacatcctgcgcgacatctccaagatcccgggcgggaacatgtacgccgacgacaccgccggctgggacacccggatcacggaggacgacctccagaacgaggcgaagatcaccgacatcatggagcccgagcacgccctgctggccaccagcatcttcaagctcacctaccagaacaaggtggtccgcgtgcagcgccccgccaagaacgggacggtgatggacgtcatctcccggcgcgaccagcggggcagcggccaggtggggacctacggcctgaacaccttcaccaacatggaggtgcagctgatccgccagatggagtccgaggggatcttcctccccagcgagctggagacgccgaacctggccgagcgggtcctcgactggctggagaagcacggcgcggagcgcctgaagcggatggccatctccggggacgactgcgtggtgaagcccatcgacgaccgcttcgccaccgccctcaccgccctgaacgacatgggcaaggtccggaaggacatcccccagtgggagcccagcaagggctggaacgactggcagcaggtcccgttctgctcccaccacttccaccagctgatcatgaaggacgggcgcgagatcgtggtcccctgccggaaccaggacgagctcgtgggccgcgcgcgggtgagccagggggccggctggtccctgcgcgagaccgcctgcctgggcaagagctacgcccagatgtggcagctcatgtacttccaccggcgcgacctgcggctggccgcgaacgccatctgctccgccgtccccgtggactgggtgcccaccagccgcacgacctggagcatccacgcccaccaccagtggatgaccaccgaggacatgctctccgtctggaaccgggtgtggatcgaggagaacccgtggatggaggacaagacgcacgtgagctcctgggaggaggtcccctacctgggcaagcgcgaggaccagtggtgcggcagcctgatcgggctcaccgcgcgcgccacctgggccaccaacatccaggtggccatcaaccaggtgcggcgcctgatcggcaacgagaactacctggactacatgacgtccatgaagcggttcaagaacgagagcgaccccgagggggccctctggtga

SEQ ID NO: 8251 - RNA, 9879 nt, synthetic construct
  misc_feature 1..9879: note = derived and/or modified CDS sequence (opt1) from DENV-1__FJ639819__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcatcttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtgaagacctgcacgtggcccaagagccacaccctgtggtccaacggggtcctcgagagcgagatgatcatccccaagatctacggcgggccgatctcccagcacaactaccggcccggctacttcacccagaccgccgggccctggcacctgggcaagctggagctcgacttcgacctgtgcgagggcacgaccgtggtggtcgacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtgaaggagaaggaggagaacctggtccgcagcatggtgtccgccggcagcggggaggtggacaacttcagcctcggcatcctgtgcgtctccatcatgatcgaggaggtgatgcggagccgctggtcccgcaagatgctgatgaccgggacgctcgccgtgttcctgctgctcatcatgggccagctgacctggaacgacctgatccggctctgcatcatggtcggggccaacgcgagcgaccgcatgggcatgggcaccacctacctggccctgatggccacgttcaagatgcggccgatgttcgccgtggggctcctgttccgccggctgacctcccgcgaggtgctcctgctgaccatcggcctcagcctggtcgcctccgtggagctgcccaacagcctcgaggagctgggggacggcctggcgatgggcatcatgatgctcaagctgctgaccgagttccagccccaccagctctggacgaccctgctgtccctcaccttcgtcaagaccacgctgagcctggactacgcctggaagaccaccgccatggtgctctccatcgtgagcctgttccccctgtgcctctccaccacgagccagaagaccacctggctgccggtcctgctcgggtccttcggctgcaagcccctgaccatgttcctgatcaccgagaacaagatctgggggcgcaagagctggcccctcaacgagggcatcatggccatcgggatcgtgtccatcctgctgagctccctcctgaagaacgacgtgcccctggcgggcccgctcatcgccggcgggatgctgatcgcctgctacgtcatcagcggcagctccgccgacctgagcctcgagaaggccgcggaggtgtcctgggagcaggaggccgagcacagcggggcctcccacaacatcctggtggaggtccaggacgacggcacgatgaagatcaaggacgaggagcgcgacgacaccctgaccatcctcctgaaggccaccctgctcgccgtgagcggggtgtaccccatgtccatccccgcgacgctgttcgtctggtacttctggcagaagaagaagcagcggagcggcgtgctgtgggacaccccctccccgcccgaggtggagcgcgccgtcctcgacgacggcatctaccggatcctgcagcgcgggctgctgggccggagccaggtgggggtgggcgtcttccaggacggggtgttccacaccatgtggcacgtgacccgcggcgccgtcctcatgtaccagggcaagcggctggagccctcctgggcctgcgtgaagaaggacctgatcagctacgggggcgggtggcgcttccagggcctctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggacctccggcagcccgatcgtgaaccgggagggcaagatcgtggggctgtacggcaacggggtcgtgaccacctccggcacgtacgtgagcgccatcgcccaggccaaggcgtcccaggaggggcccctccccgagatcgaggacgaggtcttcaagaagcgcaacctgaccatcatggacctgcacccgggcagcggcaagacccggcgctacctccccgccatcgtgcgggaggccatcaagcgcaagctgcgcaccctgatcctcgcccccacgcgggtggtcgcgtccgagatggccgaggccctgaaggggatgcccatccgctaccagaccaccgccgtcaagagcgagcacaccggccgggagatcgtggacctgatgtgccacgccacgttcaccatgcgcctcctgagcccggtccgggtgcccaactacaacatgatcatcatggacgaggcgcacttcaccgaccccgcctccatcgccgcccgcgggtacatcagcacccgggtgggcatgggggaggccgcggccatcttcatgacggccacgccgcccggctccgtcgaggccttcccccagagcaacgccgtgatccaggacgaggagcgcgacatccccgagcggtcctggaacagcggctacgactggatcaccgacttccccgggaagaccgtgtggttcgtcccctccatcaagagcggcaacgacatcgcgaactgcctgcgcaagaacgggaagcgggtgatccagctctcccgcaagacgttcgacaccgagtaccagaagaccaagaacaacgactgggactacgtggtcaccacggacatcagcgagatgggcgccaacttccgggccgaccgcgtgatcgacccccggcgctgcctgaagcccgtgatcctgaaggacgggcccgagcgggtcatcctcgccggcccgatgcccgtgaccgtcgcgtccgccgcccagcgccggggccgcatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgggagaagtccgccgccatcgacggggagtaccgcctgcggggcgaggcccgcaagacgttcgtggagctcatgcggcgcggcgacctgcccgtctggctgtcctacaaggtggccagcgaggggttccagtactccgaccggcgctggtgcttcgacggcgagcggaacaaccaggtgctcgaggagaacatggacgtcgagatctggaccaaggagggggagcgcaagaagctgcggccccgctggctggacgcgcggacctacagcgacccgctcgccctgcgcgagttcaaggagttcgccgccggccggcgctccgtgagcggcgacctgatcctcgagatcgggaagctgccccagcacctgaccctccgggcccagaacgcgctggacaacctggtgatgctccacaactccgagcagggcgggaaggcctaccgccacgccatggaggagctgcccgacaccatcgagacgctgatgctcctggccctgatcgcggtcctcaccggcggggtgaccctgttcttcctgagcggcaagggcctcgggaagaccagcatcggcctgctgtgcgtgacggcctccagcgccctcctgtggatggcctccgtcgagccccactggatcgccgcgagcatcatcctggagttcttcctcatggtgctgctgatcccggagcccgaccggcagcgcacgccccaggacaaccagctcgcctacgtggtcatcgggctgctgttcatgatcctcaccgtggccgccaacgagatgggcctgctggagaccacgaagaaggacctcgggatcggctacgtggccgcggagaaccaccagcacgccaccatgctggacgtcgacctgcacccggcctccgcctggaccctctacgccgtggcgaccacggtgatcacccccatgatgcggcacaccatcgagaacaccacggccaacatcagcctgaccgccatcgccaaccaggccgcgatcctgatgggcctcgacaaggggtggcccatctccaagatggacatcggcgtccccctgctggccctcgggtgctacagccaggtgaacccgctgaccctgaccgccgccgtgctcatgctggtcgcgcactacgccatcatcggccccgggctgcaggccaaggccacgcgcgaggcccagaagcgcaccgcggccggcatcatgaagaaccccaccgtggacggcatcgtggccatcgacctcgaccccgtcgtgtacgacgccaagttcgagaagcagctggggcagatcatgctgctcatcctgtgcacctcccagatcctgctcatgcggacgacctgggccctgtgcgagagcatcaccctggcgaccggcccgctcacgaccctgtgggaggggtcccccggcaagttctggaacaccaccatcgccgtgagcatggccaacatcttccgcggctcctacctggccggggccggcctcgcgttcagcctgatgaagtccctcgggggcgggcggcgcggcacgggcgcccagggggagaccctcggcgagaagtggaagcggcagctgaaccagctgagcaagtccgagttcaacacctacaagcgcagcgggatcatggaggtcgaccggtccgaggccaaggagggcctcaagcgcggggagaccacgaagcacgccgtgagccggggcaccgcgaagctgcgctggttcgtggagcggaacctggtcaagcccgagggcaaggtgatcgacctggggtgcggccgcgggggctggagctactactgcgccgggctcaagaaggtgaccgaggtcaagggctacaccaagggcgggcccggccacgaggagccgatccccatggccacctacgggtggaacctggtgaagctgcactccggcaaggacgtgttcttcatgccgcccgagaagtgcgacacgctcctgtgcgacatcggggagagctccccgaaccccaccatcgaggagggccggaccctgcgcgtcctcaagatggtggagccctggctgcggggcaaccagttctgcatcaagatcctgaacccctacatgccgagcgtggtcgagaccctcgagcagatgcagcgcaagcacgggggcatgctggtgcggaaccccctgtcccgcaacagcacgcacgagatgtactgggtgtcctgcgggaccggcaacatcgtcagcgccgtgaacatgacctcccggatgctcctgaaccgcttcaccatggcccaccgcaagcccacgtacgagcgggacgtggacctgggcgcggggacccgccacgtcgccgtggagcccgaggtggccaacctcgacatcatcggccagcggatcgagaacatcaagaacgagcacaagagcacctggcactacgacgaggacaacccgtacaagacctgggcctaccacgggtcctacgaggtcaagcccagcggctccgccagctccatggtgaacggggtcgtgcgcctgctgacgaagccctgggacgtgatccccatggtcacccagatcgcgatgaccgacaccacgccgttcggccagcagcgggtgttcaaggagaaggtggacacccgcacgccccgggccaagcgcggcaccacgcagatcatggaggtcaccgccaagtggctctgggggttcctgagccggaacaagaagccccgcatctgcacccgggaggagttcacccgcaaggtgcggtccaacgccgccatcggcgcggtgttcgtcgacgagaaccagtggaacagcgccaaggaggccgtggaggacgagcgcttctgggacctggtgcaccgggagcgcgagctccacaagcaggggaagtgcgccacgtgcgtctacaacatgatgggcaagcgggagaagaagctgggggagttcggcaaggcgaagggctcccgcgccatctggtacatgtggctgggggcccggttcctcgagttcgaggccctgggcttcatgaacgaggaccactggttcagccgcgagaacagcctgtccggggtggagggcgaggggctccacaagctgggctacatcctgcgggacatcagcaagatcccgggcgggaacatgtacgccgacgacaccgcgggctgggacacccgcatcaccgaggacgacctccagaacgaggccaagatcacggacatcatggagcccgagcacgccctgctggccacctccatcttcaagctcacctaccagaacaaggtggtccgcgtgcagcggcccgccaagaacgggaccgtgatggacgtcatcagccgccgggaccagcgcggctccggccaggtggggacgtacggcctgaacaccttcaccaacatggaggtgcagctgatccggcagatggagagcgaggggatcttcctcccctccgagctggagaccccgaacctggcggagcgcgtcctcgactggctggagaagcacggcgccgagcggctgaagcgcatggccatcagcggggacgactgcgtggtgaagcccatcgacgaccggttcgccacggccctcaccgcgctgaacgacatgggcaaggtccgcaaggacatcccccagtgggagccctccaagggctggaacgactggcagcaggtcccgttctgcagccaccacttccaccagctgatcatgaaggacgggcgggagatcgtggtcccctgccgcaaccaggacgagctcgtgggccgggcccgcgtgtcccagggggccggctggagcctgcgggagaccgcctgcctggggaagtcctacgcccagatgtggcagctcatgtacttccaccgccgggacctgcgcctggcggccaacgccatctgcagcgccgtccccgtggactgggtgcccacctcccggaccacgtggagcatccacgcgcaccaccagtggatgaccaccgaggacatgctctccgtctggaaccgcgtgtggatcgaggagaacccgtggatggaggacaagacccacgtgagcagctgggaggaggtcccctacctgggcaagcgcgaggaccagtggtgcggctccctgatcgggctcacggcccgggccacctgggccaccaacatccaggtggccatcaaccaggtgcgccggctgatcggcaacgagaactacctggactacatgaccagcatgaagcgcttcaagaacgagtccgaccccgagggggcgctctggtga

SEQ ID NO: 8252 - RNA, 9879 nt, synthetic construct
  misc_feature 1..9879: note = derived and/or modified CDS sequence (opt1) from DENV-1__FJ639820__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacctacctggccctcatggccacgttcaagatgcgcccgatgttcgccgtggggctgctgttccggcgcctcaccagccgggaggtgctgctgctcaccatcgggctgtccctggtcgccagcgtggagctccccaactccctggaggagctgggggacggcctcgcgatgggcatcatgatgctgaagctgctcaccgagttccagccccaccagctgtggacgaccctgctcagcctgaccttcgtcaagaccacgctgtccctcgactacgcctggaagaccaccgccatggtgctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcacgatgaagatcaaggacgaggagcgggacgacaccctcaccatcctgctgaaggccaccctcctggccgtgtccggggtgtaccccatgagcatccccgcgacgctgttcgtctggtacttctggcagaagaagaagcagcgctccggcgtgctctgggacacccccagcccgcccgaggtggagcgggccgtcctggacgacggcatctaccgcatcctgcagcgggggctgctcggccgctcccaggtgggggtgggcgtcttccaggacggggtgttccacaccatgtggcacgtgacccggggcgccgtcctgatgtaccagggcaagcgcctggagcccagctgggcctccgtgaagaaggacctcatcagctacgggggcgggtggcggttccagggctcctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggaccagcggctccccgatcgtgaaccgcgagggcaagatcgtggggctgtacggcaacggggtcgtgaccaccagcggcacgtacgtgtccgccatcgcccaggccaaggcgagccaggaggggcccctccccgagatcgaggacgaggtcttcaagaagcggaacctgaccatcatggacctgcacccgggcagcggcaagacccgccggtacctccccgccatcgtgcgcgaggccatcaagcggaagctgcgcaccctgatcctcgcccccacgcgcgtggtcgcgtccgagatggccgaggccctgaaggggatgcccatccggtaccagaccaccgccgtcaagagcgagcacaccggccgcgagatcgtggacctgatgtgccacgccacgttcaccatgcggctcctgtccccggtccgcgtgcccaactacaacatgatcatcatggacgaggcgcacttcaccgaccccgccagcatcgccgcccgggggtacatctccacccgcgtgggcatgggggaggccgcggccatcttcatgacggccacgccgcccggcagcgtcgaggccttcccccagtccaacgccgtgatccaggacgaggagcgggacatccccgagcgcagctggaactccggctacgactggatcaccgacttccccgggaagaccgtgtggttcgtccccagcatcaagtccggcaacgacatcgcgaactgcctgcggaagaacgggaagcgcgtgatccagctcagccggaagacgttcgacaccgagtaccagaagaccaagaacaacgactgggactacgtggtcaccacggacatctccgagatgggcgccaacttccgcgccgaccgggtgatcgacccccgccggtgcctgaagcccgtgatcctgaaggacgggcccgagcgcgtcatcctcgccggcccgatgcccgtgaccgtcgcgagcgccgcccagcggcgcggccggatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagacgttcgtggagctcatgcgccggggcgacctgcccgtctggctgagctacaaggtggcctccgaggggttccagtacagcgaccgccggtggtgcttcgacggcgagcgcaacaaccaggtgctcgaggagaacatggacgtcgagatctggaccaaggagggggagcggaagaagctgcgcccccggtggctggacgcgcgcacctactccgacccgctcgccctgcgggagttcaaggagttcgccgccggccgccggagcgtgagcggcgacctgatcctcgagatcgggaagctgccccagcacctgaccctccgcgcccagaacgcgctggacaacctggccatgctccacaactccgagcagggcgggaaggcctaccggcacgccatggaggagctgcccgacaccatcgagacgctgatgctcctggcgctgatcgccgtgctcaccggcggggtcaccctgttcttcctgagcggcaagggcctcgggaagacctccatcggcctgctgtgcgtgacggccagctccgccctcctgtggatggccagcgtggagccccactggatcgcggcctccatcatcctggagttcttcctcatggtcctgctgatcccggagcccgaccgccagcggacgccccaggacaaccagctcgcctacgtggtgatcgggctgctgttcatgatcctcaccgtcgccgccaacgagatgggcctgctggagaccacgaagaaggacctcgggatcggctacgtggcggccgagaaccaccagcacgccaccatgctggacgtggacctgcgcccggccagcgcctggaccctctacgcggtcgccaccacggtgatcacccccatgatgcggcacaccatcgagaacaccacggccaacatctccctgaccgccatcgccaaccaggcggccatcctgatgggcctcgacaaggggtggcccatcagcaagatggacatcggcgtgcccctgctggccctcgggtgctactcccaggtcaacccgctgaccctgaccgccgcggtgctcatgctggtggcccactacgccatcatcggccccgggctgcaggccaaggccacgcgcgaggcgcagaagcgcaccgccgccggcatcatgaagaaccccaccgtcgacggcatcgtggccatcgacctcgaccccgtggtctacgacgccaagttcgagaagcagctggggcagatcatgctgctcatcctgtgcaccagccagatcctgctcatgcggacgacctgggcgctgtgcgagtccatcaccctggccaccggcccgctcacgaccctgtgggaggggagccccggcaagttctggaacaccaccatcgccgtgtccatggccaacatcttccgcggcagctacctggccggggcgggcctcgccttctccctgatgaagtccctcgggggcgggcggcgcgggacgggcgcccagggggagaccctcggcgagaagtggaagcggcagctgaaccagctgtccaagagcgagttcaacacctacaagcgcagcgggatcatggaggtggaccggtccgaggccaaggagggcctcaagcgcggggagaccacgaagcacgcggtcagccggggcaccgccaagctgcgctggttcgtggagcggaacctggtgaagcccgagggcaaggtcatcgacctggggtgcggccgcgggggctggtcctactactgcgccgggctcaagaaggtgaccgaggtgaagggctacaccaagggcgggcccggccacgaggagccgatccccatggccacctacgggtggaacctggtcaagctgcacagcggcaaggacgtgttcttcatgccgcccgagaagtgcgacacgctcctgtgcgacatcggggagtccagcccgaaccccaccatcgaggagggccggaccctgcgcgtgctcaagatggtcgagccctggctgaagggcaaccagttctgcatcaagatcctgaacccctacatgccgtccgtggtggagaccctcgagcagatgcagcggaagcacgggggcatgctggtccgcaaccccctgagccggaactccacgcacgagatgtactgggtgagctgcgggaccggcaacatcgtgtccgccgtcaacatgaccagccgcatgctcctgaaccggttcaccatggcgcaccgcaagcccacgtacgagcgcgacgtggacctgggcgccgggacccggcacgtggccgtcgagcccgaggtggccaacctcgacatcatcggccagcgcatcgagaacatcaagaacgagcacaagtccacctggcactacgacgaggacaacccgtacaagacctgggcctaccacgggagctacgaggtgaagccctccggcagcgcgtccagcatggtcaacggggtggtccggctgctgacgaagccctgggacgtgatccccatggtgacccagatcgccatgaccgacaccacgccgttcggccagcagcgcgtcttcaaggagaaggtggacacccggacgccccgcgccaagcggggcaccacgcagatcatggaggtgaccgccaagtggctctgggggttcctgtcccgcaacaagaagccccggatctgcacccgcgaggagttcacccggaaggtccgcagcaacgccgcgatcggcgccgtgttcgtggacgagaaccagtggaacagcgccaaggaggccgtcgaggacgagcggttctgggacctggtgcaccgcgagcgggagctccacaagcaggggaagtgcgcgacgtgcgtgtacaacatgatgggcaagcgcgagaagaagctgggggagttcggcaaggccaagggctcccgggccatctggtacatgtggctgggggcccgcttcctcgagttcgaggccctgggcttcatgaacgaggaccactggttcagccgggagaactccctgagcggggtcgagggcgaggggctccacaagctgggctacatcctgcgcgacatctccaagatcccgggcgggaacatgtacgcggacgacaccgccggctgggacacccggatcaccgaggacgacctccagaacgaggccaagatcacggacatcatggagcccgagcacgccctgctggccaccagcatcttcaagctcacctaccagaacaaggtggtgcgcgtccagcgccccgcgaagaacgggaccgtgatggacgtgatctcccggcgcgaccagcggggcagcggccaggtcgggacgtacggcctgaacaccttcaccaacatggaggtgcagctgatccgccagatggagtccgaggggatcttcctccccagcgagctggagaccccgaacctggccgagcgggtgctcgactggctggagaagcacggcgccgagcgcctgaagcggatggccatctccggggacgactgcgtcgtgaagcccatcgacgaccgcttcgccacggcgctcaccgccctgaacgacatgggcaaggtgcggaaggacatcccccagtgggagcccagcaagggctggaacgactggcagcaggtcccgttctgctcccaccacttccaccagctgatcatgaaggacgggcgcgagatcgtggtgccctgccggaaccaggacgagctcgtcggccgcgcccgggtgagccagggggccggctggtccctgcgcgagaccgcctgcctgggcaagagctacgcgcagatgtggcagctcatgtacttccaccggcgcgacctgcggctggccgccaacgccatctgctccgcggtgcccgtcgactgggtgcccaccagccgcaccacgtggagcatccacgcccaccaccagtggatgaccaccgaggacatgctctccgtgtggaaccgggtctggatcgaggagaacccgtggatggaggacaagacccacgtgagctcctgggaggaggtgccctacctgggcaagcgcgaggaccagtggtgcggcagcctgatcgggctcacggcccgcgccacctgggccaccaacatccaggtcgcgatcaaccaggtgcggcgcctgatcggcaacgagaactacctggactacatgacctccatgaagcggttcaagaacgagagcgaccccgagggggccctctggtga

SEQ ID NO: 8253 - RNA, 9879 nt, synthetic construct
  misc_feature 1..9879: note = derived and/or modified CDS sequence (opt1) from DENV-1__FJ639821__SS-prME
  source 1..9879: mol_type = other RNA
agcgccaccatgctgctcatgctgctgcccaccgccctcgccttccacctgaccacccgcggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtcgcgctggcgccccacgtgggcctggggctcgagacgcgcaccgagacctggatgagctccgagggcgcctggaagcagatccagcgggtggagacctgggccctgcgccacccggggttcacggtgatcgccttcttcctggcccacgccatcggcaccagcatcacccagaaggggatcatcttcatcctcctgatgctggtgaccccctccatggccatgcggtgcgtgggcatcggcaaccgcgacttcgtcgaggggctcagcggcgccacgtgggtggacgtggtcctggagcacgggtcctgcgtgaccaccatggcgaagaacaagcccaccctggacatcgagctcctgaagacggaggtgaccaaccccgccgtcctgcggaagctctgcatcgaggccaagatcagcaacaccaccacggactcccgctgcccgacccagggcgaggccaccctggtggaggagcaggacgccaacttcgtgtgccggcgcaccttcgtcgaccggggctgggggaacggctgcgggctgttcggcaaggggagcctcctgacgtgcgcgaagttcaagtgcgtgaccaagctggagggcaagatcgtgcagtacgagaacctcaagtactccgtcatcgtgaccgtgcacaccggcgaccagcaccaggtcgggaacgagacgaccgagcacggcaccatcgccaccatcacgccccaggcccccacgagcgagatccagctgaccgactacggggccctgaccctcgactgcagcccccggaccggcctggacttcaacgagatggtgctgctcacgatgaaggagaagtcctggctggtccacaagcagtggttcctggacctcccgctgccctggacctccggggccagcaccagccaggagacctggaaccggcaggacctgctcgtgacgttcaagaccgcgcacgccaagaagcaggaggtggtcgtgctgggctcccaggagggcgccatgcacaccgccctgaccggggccacggagatccagaccagcggcaccaccacgatcttcgcggggcacctcaagtgccgcctgaagatggacaagctgaccctcaagggcatgtcctacgtgatgtgcaccgggagcttcaagctggagaaggaggtcgccgagacccagcacggcacggtgctggtgcaggtccggtacgagggcaccgacgccccctgcaagatccccttctccacccaggacgagaagggggtgacccagaacggccgcctgatcacggccaacccgatcgtgaccgacaaggagaagcccgtcaacatcgagaccgagccgcccttcggggagagctacatcgtggtgggcgcgggcgagaaggccctcaagctgtcctggttcaagcgggggagctccatcggcaagatgttcgaggccaccgcccgcggggcccgccggatggcgatcctgggcgacacggcctgggacttcgggagcatcggcggcgtcttcacctccgtggggaagctcgtgcaccaggtcttcggcaccgcctacggggtgctgttcagcggcgtgtcctggaccatgaagatcgggatcggcatcctgctcacgtggctgggcctgaacagccgctccaccagcctctccatgacctgcatcgccgtcgggatggtgaccctgtacctgggcgtgatggtccaggccgacagcgggtgcgtgatcaactggaagggccgggagctcaagtgcgggtccggcatcttcgtgacgaacgaggtccacacctggaccgagcagtacaagttccaggcggacagcccgaagcgcctgagcgccgccatcggcaaggcctgggaggagggggtgtgcggcatccggtccgccacccgcctggagaacatcatgtggaagcagatcagcaacgagctcaaccacatcctgctggagaacgacatgaagttcaccgtggtcgtgggggacgcgaacggcatcctcgcccaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcgtggaacatctgggaggtggaggactacgggttcggcatcttcaccacgaacatctggctgaagctgcgggactcctacacccagatgtgcgaccaccgcctcatgagcgccgccatcaaggactccaaggccgtccacgccgacatgggctactggatcgagagcgagaagaacgagacctggaagctggcgcgggcctccttcatcgaggtgaagacctgcacgtggcccaagagccacaccctgtggtccaacggggtgctcgagagcgagatgatcatccccaagatctacggcgggccgatctcccagcacaactaccgccccggctactacacccagaccgccgggccctggcacctgggcaagctggagctcgacttcgacctgtgcgagggcacgaccgtcgtggtggacgagcactgcgggaaccggggcccgagcctgcgcaccaccacggtcaccgggaagatcatccacgagtggtgctgccggtcctgcaccctgccgcccctgcgcttccggggcgaggacgggtgctggtacggcatggagatccgccccgtgaaggagaaggaggagaacctggtgcggagcatggtctccgccggcagcggggaggtggacaacttcagcctcggcatcctgtgcgtgtccatcatgatcgaggaggtcatgcgcagccgctggtcccggaagatgctgatgaccgggacgctcgccgtgttcctgctgctcatcatgggccagctgacctggaacgacctgatccgcctctgcatcatggtgggggcgaacgccagcgacggcatgggcatggggaccacctacctggccctgatggccacgttcaagatgcggccgatgttcgccgtcggcctcctgttccgccggctgacctcccgcgaggtgctcctgctgaccatcgggctcagcctggtggcgtccgtcgagctgcccaacagcctcgaggagctgggcgacggcctggccatggggatcatgatgctcaagctgctgaccgagttccagccccaccagctctggacgaccctgctgtccctcaccttcgtgaagaccacgctgagcctggactacgcctggaagaccaccgccatggtcctctccatcgtgagcctgttccccctgtgcctctccaccacgagccagaagaccacctggctgccggtgctgctcggctccttcgggtgcaagcccctgaccatgttcctgatcaccgagaacaagatctggggccgcaagagctggcccctcaacgaggggatcatggcgatcggcatcgtctccatcctgctgagctccctcctgaagaacgacgtgcccctggccggcccgctcatcgccgggggcatgctgatcgcctgctacgtgatcagcgggagctccgccgacctgagcctcgacaaggcggccgaggtctcctgggagcaggaggccgagcacagcggcgcctcccacaacatcagcgtggaggtgcaggacgacgggacgatgaagatcaaggacgaggagcgcgacgacaccctgaccatcctgctcaaggccaccctgctggcggtctccggcgtgtaccccatgagcatccccgccaccctcttcgtgtggtacttctggcagaagaagaagcagcggtccggcgtcctgtgggacacccccagcccgcccgaggtggagcgcgccgtgctggacgacgggatctaccggatcctccagcgcggcctgctggggcggtcccaggtcggcgtgggggtgttccaggacggcgtcttccacaccatgtggcacgtgacccgcggcgccgtgctgatgtaccaggggaagcggctcgagcccagctgggcctgcgtcaagaaggacctgatctcctacggcgggggctggcgcttccaggggagctggaacacgggcgaggaggtccaggtgatcgcggtcgagcccggcaagaacccgaagaacgtgcagaccacccccgggaccttcaagacgcccgagggcgaggtgggggccatcgccctggacttcaagcccggcacctccggcagcccgatcgtcaaccgggaggggaagatcgtgggcctctacgggaacggcgtggtcaccacctccgggacgtacgtgagcgccatcgcccaggcgaaggcctcccaggagggccccctgcccgagatcgaggacgaggtgttcaagaagcgcaacctgaccatcatggacctccacccgggcagcgggaagacccggcgctacctgcccgccatcgtccgggaggccatcaagcgcaagctgcgcaccctcatcctggcgcccacgcgggtggtggccagcgagatggccgaggccctgaagggcatgcccatccgctaccagaccaccgccgtcaagtccgagcacaccgggcgggagatcgtggacctcatgtgccacgcgacgttcaccatgcgcctgctgagcccggtgcgggtccccaactacaacatgatcatcatggacgaggcccacttcaccgaccccgcctccatcgccgcccgcggctacatcagcacccgggtggggatgggcgaggcggccgccatcttcatgacggccacgccgcccggctccgtggaggccttcccccagagcaacgcggtcatccaggacgaggagcgcgacatccccgagcggtcctggaacagcgggtacgactggatcaccgacttccccggcaagaccgtgtggttcgtgccctccatcaagagcgggaacgacatcgccaactgcctccgcaagaacggcaagcgggtcatccagctgtcccgcaagacgttcgacaccgagtaccagaagaccaagaacaacgactgggactacgtggtgaccacggacatcagcgagatgggggccaacttccgggccgaccgcgtcatcgacccccggcgctgcctgaagcccgtgatcctcaaggacggccccgagcgggtgatcctggcgggcccgatgcccgtcaccgtggcctccgccgcccagcgccgggggcgcatcggccgcaaccagaacaaggagggggaccagtacgtctacatgggccagcccctgaacaacgacgaggaccacgcccactggaccgaggcgaagatgctcctggacaacatcaacacccccgaggggatcatcccggccctgttcgagcccgagcgggagaagtccgccgccatcgacggcgagtaccgcctccggggcgaggcccgcaagacgttcgtggagctgatgcggcgcggggacctgcccgtgtggctctcctacaaggtcgcgagcgagggcttccagtactccgaccggcgctggtgcttcgacggggagcggaacaaccaggtgctggaggagaacatggacgtggagatctggaccaaggagggcgagcgcaagaagctgcggccccgctggctcgacgcccggacctacagcgacccgctggccctgcgcgagttcaaggagttcgccgccggccggcgctccgtcagcggggacctcatcctggagatcggcaagctgccccagcacctcaccctgcgggcgcagaacgccctggacaacctcgtgatgctgcacaacagcgagcagggcgggaaggcctaccgccacgccatggaggagctgcccgacaccatcgagacgctcatgctgctggcgctcatcgccgtgctgaccgggggcgtcaccctgttcttcctctccggcaaggggctgggcaagaccagcatcgggctgctctgcgtgacggcctccagcgccctgctgtggatggcctccgtggagccccactggatcgcggccagcatcatcctcgagttcttcctgatggtcctgctcatcccggagcccgaccggcagcgcacgccccaggacaaccagctggcctacgtggtgatcggcctcctcttcatgatcctgaccgtcgccgccaacgagatggggctgctcgagaccacgaagaaggacctgggcatcggctacgtggcggccgagaaccaccagcacgccaccatgctggacgtggacctccacccggcctccgcctggaccctgtacgcggtcgccaccacggtgatcacccccatgatgcggcacaccatcgagaacaccacggccaacatcagcctgaccgccatcgccaaccaggcggccatcctcatggggctggacaagggctggcccatctccaagatggacatcggggtgcccctgctcgccctgggctgctacagccaggtcaacccgctgaccctcaccgccgcggtgctgatgctggtggcccactacgccatcatcgggcccggcctccaggccaaggccacgcgcgaggcgcagaagcgcaccgccgccggcatcatgaagaaccccaccgtcgacgggatcgtggccatcgacctggaccccgtggtctacgacgtgaagttcgagaagcagctgggccagatcatgctcctgatcctgtgcacctcccagatcctcctgatgcggacgacctgggccctgtgcgagagcatcaccctcgcgaccgggccgctgacgaccctgtgggagggctcccccggcaagttctggaacaccaccatcgccgtgagcatggccaacatcttccgcgggtcctacctcgccggcgccgggctggcgttcagcctgatgaagtccctcggcgggggccggcgcggcacgggggcccagggcgagaccctgggggagaagtggaagcggcagctgaaccagctcagcaagtccgagttcaacacctacaagcgcagcggcatcatggaggtcgaccggagcgaggccaaggaggggctgaagcgcggcgagaccacgaaccacgccgtgtcccggggcaccgcgaagctgcgctggttcgtggagcggaacctcgtcaagcccgaggggaaggtgatcgacctgggctgcgggcgcggcgggtggagctactactgcgccggcctgaagaaggtgaccgaggtcaagggctacaccaagggcgggcccgggcacgaggagccgatccccatggccacctacggctggaacctggtgaagctccactccgggaaggacgtgttcttcatgccgcccgagaagtgcgacacgctgctgtgcgacatcggcgagagctccccgaaccccaccatcgaggagggccggaccctccgcgtcctgaagatggtggagccctggctgcgggggaaccagttctgcatcaagatcctcaacccctacatgccgagcgtggtcgagaccctggagcagatgcagcgcaagcacggcgggatgctggtgcggaaccccctctcccgcaacagcacgcacgagatgtactgggtgtcctgcggcaccggcaacatcgtcagcgccgtgaacatgacctcccggatgctgctgaaccgcttcaccatggcccaccgcaagcccacgtacgagcgggacgtggacctcggggcgggcacccgccacgtcaccgtggagcccgaggtggccaacctggacatcatcgggcagcggatcgagaacatcaagaacgagcacaagagcacctggcactacgacgaggacaacccgtacaagacgtgggcctaccacggctcctacgaggtcaagcccagcgggtccgccagctccatggtgaacggcgtcgtgcgcctgctcaccaagccctgggacgtgatccccatggtcacccagatcgccatgaccgacacgaccccgttcggccagcagcgggtgttcaaggagaaggtggacacccgcacgccccgggcgaagcgcgggacgacccagatcatggaggtcaccgccaagtggctgtggggcttcctgagccggaacaagaagccccgcatctgcacccgggaggagttcacgcgcaaggtgcggtccaacgccgccatcggggccgtgttcgtcgacgagaaccagtggaacagcgcgaaggaggccgtggaggacgagcgcttctgggacctcgtgcaccgggagcgcgagctgcacaagcagggcaagtgcgcgacctgcgtctacaacatgatggggaagcgggagaagaagctgggcgagttcggcaaggccaaggggagccgcgcgatctggtacatgtggctcggcgcccggttcctggagttcgaggccctggggttcatgaacgaggaccactggttctcccgcgagaacagcctctccggcgtggagggggagggcctgcacaagctgggctacatcctccgggacatcagcaagatccccggcgggaacatgtacgccgacgacaccgccgggtgggacacccgcatcacggaggacgacctgcagaacgaggcgaagatcaccgacatcatggagcccgagcacgccctgctcgccacctccatcttcaagctgacctaccagaacaaggtggtccgcgtgcagcggcccgccaagaacgggacggtgatggacgtcatcagccgccgggaccagcgcggctccggccaggtgggcacctacgggctgaacaccttcaccaacatggaggtgcagctcatccggcagatggagagcgagggcatcttcctgccctccgagctggagacgccgaacctcgccgagcgcgtcctggactggctggagaagcacggggcggagcggctcaagcgcatggccatcagcggcgacgactgcgtggtgaagcccatcgacgaccggttcgccaccgccctgaccgccctgaacgacatgggcaaggtccgcaaggacatcccccagtgggagccctccaaggggtggaacgactggcagcaggtcccgttctgcagccaccacttccaccagctcatcatgaaggacggccgggagatcgtggtcccctgccgcaaccaggacgagctggtggggcgggcgcgcgtgtcccagggcgccgggtggagcctgcgggagaccgcctgcctcggcaagtcctacgcccagatgtggcagctgatgtacttccaccgccgggacctgcgcctcgccgcgaacgccatctgcagcgccgtccccgtggactgggtgcccacctcccggacgacctggagcatccacgcccaccaccagtggatgaccaccgaggacatgctgagcgtctggaaccgcgtgtggatcgaggagaacccgtggatggaggacaagacgcacgtgtccagctgggaggaggtcccctacctgggcaagcgcgaggaccagtggtgcgggtccctcatcggcctgaccgcgcgggccacctgggccaccaacatccaggtggccatcaaccaggtgcgccggctgatcgggaacgagaactacctcgactacatgacgagcatgaagcgcttcaagaacgagtccgaccccgagggcgccctgtggtga

SEQ ID NO: 8254 - RNA, 9879 nt, synthetic construct
  misc_feature 1..9879: note = derived and/or modified CDS sequence (opt1) from DENV-1__FJ639824__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacctacctggccctcatggccacgttcaagatgcgcccgatgttcgccgtggggctgctgttccggcgcctcaccagccgggaggtgctgctgctcaccatcgggctgtccctggtcgccagcgtggagctccccaactccctggaggagctgggggacggcctcgcgatgggcatcatgatgctgaagctgctcaccgagttccagccccaccagctgtggacgaccctgctcagcctgaccttcgtcaagaccacgctgtccctcgactacgcctggaagaccaccgccatggtgctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgcgggcccgctggtcgccggcgggatgctgatcgcctgctacgtgatcagcggctccagcgccgacctctccctggagaaggccgcggaggtgagctgggagcaggaggccgagcactccggggccagccacaacatcctggtcgaggtgcaggacgacggcacgatgaagatcaaggacgaggagcgggacgacaccctcaccatcctgctgaaggccaccctcctggccgtgtccggggtctaccccatgagcatccccgcgacgctgttcgtgtggtacttctggcagaagaagaagcagcgctccggcgtgctctgggacacccccagcccgcccgaggtcgagcgggccgtgctggacgacggcatctaccgcatcctgcagcgggggctgctcggccgctcccaggtgggggtcggcgtgttccaggacggggtgttccacaccatgtggcacgtcacccggggcgccgtgctgatgtaccagggcaagcgcctggagcccagctgggcctccgtgaagaaggacctcatcagctacgggggcgggtggcggttccagggctcctggaacacgggggaggaggtccaggtgatcgccgtggagcccggcaagaacccgaagaacgtccagaccacccccggcaccttcaagacgcccgagggggaggtgggcgcgatcgccctggacttcaagcccgggaccagcggctccccgatcgtgaaccgcgagggcaagatcgtcgggctgtacggcaacggggtggtgaccaccagcggcacgtacgtctccgccatcgcccaggccaaggcgagccaggaggggcccctccccgagatcgaggacgaggtgttcaagaagcggaacctgaccatcatggacctgcacccgggcagcggcaagacccgccggtacctccccgccatcgtgcgcgaggccatcaagcggaagctgcgcaccctgatcctcgcccccacgcgcgtcgtggcgtccgagatggccgaggccctgaaggggatgcccatccggtaccagaccaccgccgtcaagagcgagcacaccggccgcgagatcgtcgacctgatgtgccacgccacgttcaccatgcggctcctgtccccggtgcgcgtgcccaactacaacatgatcatcatggacgaggcgcacttcaccgaccccgccagcatcgccgcccgggggtacatctccacccgcgtcggcatgggggaggccgcggccatcttcatgacggccacgccgcccggcagcgtggaggccttcccccagtccaacgccgtgatccaggacgaggagcgggacatccccgagcgcagctggaactccggctacgactggatcaccgacttccccgggaagaccgtctggttcgtgcccagcatcaagtccggcaacgacatcgcgaactgcctgcggaagaacgggaagcgcgtgatccagctcagccggaagacgttcgacaccgagtaccagaagaccaagaacaacgactgggactacgtcgtgaccacggacatctccgagatgggcgccaacttccgcgccgaccgggtgatcgacccccgccggtgcctgaagcccgtcatcctgaaggacgggcccgagcgcgtgatcctcgccggcccgatgcccgtcaccgtggcgagcgccgcccagcggcgcggccggatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagacgttcgtcgagctcatgcgccggggcgacctgcccgtgtggctgagctacaaggtggcctccgaggggttccagtacagcgaccgccggtggtgcttcgacggcgagcgcaacaaccaggtcctcgaggagaacatggacgtggagatctggaccaaggagggggagcggaagaagctgcgcccccggtggctggacgcgcgcacctactccgacccgctcgccctgcgggagttcaaggagttcgccgccggccgccggagcgtgagcggcgacctgatcctcgagatcgggaagctgccccagcacctgaccctccgcgcccagaacgcgctggacaacctggtcatgctccacaactccgagcagggcgggaaggcctaccggcacgccatggaggagctgcccgacaccatcgagacgctgatgctcctggccctgatcgcggtgctcaccggcggggtgaccctgttcttcctgagcggcaagggcctcgggaagacctccatcggcctgctgtgcgtcacggccagctccgccctcctgtggatggccagcgtggagccccactggatcgccgcgtccatcatcctggagttcttcctcatggtgctgctgatcccggagcccgaccgccagcggacgccccaggacaaccagctcgcctacgtcgtgatcgggctgctgttcatgatcctcaccgtggccgccaacgagatgggcctgctggagaccacgaagaaggacctcgggatcggctacgtcgccgcggagaaccaccagcacgccaccatgctggacgtggacctgcgcccggccagcgcctggaccctctacgccgtggcgaccacggtcatcacccccatgatgcggcacaccatcgagaacaccacggccaacatctccctgaccgccatcgccaaccaggccgcgatcctgatgggcctcgacaaggggtggcccatcagcaagatggacatcggcgtgcccctgctggccctcgggtgctactcccaggtgaacccgctgaccctgaccgccgccgtcctcatgctggtggcgcactacgccatcatcggccccgggctgcaggccaaggccacgcgcgaggcccagaagcgcaccgcggccggcatcatgaagaaccccaccgtggacggcatcgtcgccatcgacctcgaccccgtggtgtacgacgccaagttcgagaagcagctggggcagatcatgctgctcatcctgtgcaccagccagatcctgctcatgcggacgacctgggccctgtgcgagtccatcaccctggcgaccggcccgctcacgaccctgtgggaggggagccccggcaagttctggaacaccaccatcgccgtctccatggccaacatcttccgcggcagctacctggccggggccggcctcgcgttctccctgatgaagtccctcgggggcgggcggcgcgggacgggcgcccagggggagaccctcggcgagaagtggaagcggcagctgaaccagctgtccaagagcgagttcaacacctacaagcgcagcgggatcatggaggtggaccggtccgaggccaaggagggcctcaagcgcggggagaccacgaagcacgccgtgagccggggcaccgcgaagctgcgctggttcgtcgagcggaacctggtgaagcccgagggcaaggtgatcgacctggggtgcggccgcgggggctggtcctactactgcgccgggctcaagaaggtcaccgaggtgaagggctacaccaagggcgggcccggccacgaggagccgatccccatggccacctacgggtggaacctggtgaagctgcacagcggcaaggacgtcttcttcatgccgcccgagaagtgcgacacgctcctgtgcgacatcggggagtccagcccgaaccccaccatcgaggagggccggaccctgcgcgtgctcaagatggtggagccctggctgaagggcaaccagttctgcatcaagatcctgaacccctacatgccgtccgtcgtggagaccctcgagcagatgcagcggaagcacgggggcatgctggtgcgcaaccccctgagccggaactccacgcacgagatgtactgggtcagctgcgggaccggcaacatcgtgtccgccgtgaacatgaccagccgcatgctcctgaaccggttcaccatggcccaccgcaagcccacgtacgagcgcgacgtcgacctgggcgcggggacccggcacgtggccgtggagcccgaggtcgccaacctcgacatcatcggccagcgcatcgagaacatcaagaacgagcacaagtccacctggcactacgacgaggacaacccgtacaagacctgggcctaccacgggagctacgaggtgaagccctccggcagcgcctccagcatggtcaacggggtggtgcggctgctgacgaagccctgggacgtcatccccatggtgacccagatcgcgatgaccgacaccacgccgttcggccagcagcgcgtgttcaaggagaaggtcgacacccggacgccccgcgccaagcggggcaccacgcagatcatggaggtgaccgccaagtggctctgggggttcctgtcccgcaacaagaagccccggatctgcacccgcgaggagttcacccggaaggtgcgcagcaacgccgccatcggcgcggtcttcgtggacgagaaccagtggaacagcgccaaggaggccgtggaggacgagcggttctgggacctggtccaccgcgagcgggagctccacaagcaggggaagtgcgccacgtgcgtgtacaacatgatgggcaagcgcgagaagaagctgggggagttcggcaaggcgaagggctcccgggccatctggtacatgtggctgggggcccgcttcctcgagttcgaggccctgggcttcatgaacgaggaccactggttcagccgggagaactccctgagcggggtggagggcgaggggctccacaagctgggctacatcctgcgcgacatctccaagatcccgggcgggaacatgtacgccgacgacaccgcgggctgggacacccggatcaccgaggacgacctccagaacgaggccaagatcacggacatcatggagcccgagcacgccctgctggccaccagcatcttcaagctcacctaccagaacaaggtcgtgcgcgtgcagcgccccgccaagaacgggaccgtcatggacgtgatctcccggcgcgaccagcggggcagcggccaggtggggacgtacggcctgaacaccttcaccaacatggaggtccagctgatccgccagatggagtccgaggggatcttcctccccagcgagctggagaccccgaacctggcggagcgggtgctcgactggctggagaagcacggcgccgagcgcctgaagcggatggccatctccggggacgactgcgtggtcaagcccatcgacgaccgcttcgccacggccctcaccgcgctgaacgacatgggcaaggtgcggaaggacatcccccagtgggagcccagcaagggctggaacgactggcagcaggtcccgttctgctcccaccacttccaccagctgatcatgaaggacgggcgcgagatcgtcgtgccctgccggaaccaggacgagctcgtgggccgcgcccgggtcagccagggggccggctggtccctgcgcgagaccgcctgcctgggcaagagctacgcccagatgtggcagctcatgtacttccaccggcgcgacctgcggctggcggccaacgccatctgctccgccgtgcccgtggactgggtccccaccagccgcaccacgtggagcatccacgcgcaccaccagtggatgaccaccgaggacatgctctccgtgtggaaccgggtgtggatcgaggagaacccgtggatggaggacaagacccacgtcagctcctgggaggaggtgccctacctgggcaagcgcgaggaccagtggtgcggcagcctgatcgggctcacggcccgcgccacctgggccaccaacatccaggtggccatcaaccaggtccggcgcctgatcggcaacgagaactacctggactacatgacctccatgaagcggttcaagaacgagagcgaccccgagggggcgctctggtga

SEQ ID NO: 8255 - RNA, 9879 nt, synthetic construct
  misc_feature 1..9879: note = derived and/or modified CDS sequence (opt1) from DENV-1__JN819425__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctgtggtccaacggggtgctcgagagcgagatgatcatccccaagatctacggcgggccgatctcccagcacaactaccggcccggctacttcacccagaccgccgggccctggcacctgggcaagctggagctcgacttcgacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgtgagcatcatgatcgaggaggtgatgcggtcccgctggagccgcaagatgctgatgaccgggacgctcgccgtcttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtggggctcctgttccgccggctgaccagccgcgaggtcctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatggtgctcagcatcgtctccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggccatcgggatcgtgagcatcctgctgtccagcctcctgaagaacgacgtccccctggcgggcccgctcatcgccggcgggatgctgatcgcctgctacgtgatcagcggctccagcgccgacctgtccctcgagaaggccgtgaagatcagctgggagcaggaggcggagcactccggggccagccacaacatcctggtcgaggtgcaggacgacggcacgatgaagatcaaggacgaggagcgcgacgacaccctgaccatcctcctgaaggccaccctgctcgccgtgtccggggtctaccccatgagcatccccgccacgctgttcgtgtggtacttctggcagaagaagaagcagcggtccggcgtgctgtgggacacccccagcccgcccgaggtcgagcgcgcggtgctcgacgacggcatctaccggatcctgcagcgcgggctgctgggccggtcccaggtgggggtcggcgtgttccaggacggggtgttccacaccatgtggcacgtcacccgcggcgccgtgctcatgtaccagggcaagcggctggagcccagctgggcctccgtgaagaaggacctgatcagctacgggggcgggtggcgcttccagggctcctggaacacgggggaggaggtccaggtgatcgccgtggagcccggcaagaacccgaagaacgtccagaccacccccggcaccttcaagacgcccgagggggaggtgggcgccatcgcgctcgacttcaagcccgggaccagcggctccccgatcgtgaaccgggagggcaagatcgtcgggctgtacggcaacggggtggtgaccaccagcggcacgtacgtctccgccatcgcccaggccaaggccagccaggaggggcccctgcccgagatcgaggacgaggtgttcaagaagcgcaacctcaccatcatggacctgcacccgggcagcggcaagacccggcgctacctgcccgcgatcgtgcgggaggccatcaagcgcaagctccgcaccctgatcctggcccccacgcgggtcgtggcctccgagatggcggaggccctcaaggggatgcccatccgctaccagaccaccgccgtcaagagcgagcacaccggccgggagatcgtcgacctgatgtgccacgccacgttcaccatgcgcctgctctccccggtgcgggtgcccaactacaacatgatcatcatggacgaggcccacttcaccgaccccgcgagcatcgccgcccgcgggtacatctccacccgggtcggcatgggggaggccgccgcgatcttcatgacggccacgccgcccggcagcgtggaggccttcccccagtccaacgccgtgatccaggacgaggagcgcgacatccccgagcggagctggaactccggctacgactggatcaccgacttccccgggaagaccgtctggttcgtgcccagcatcaagtccggcaacgacatcgccaactgcctgcgcaagaacgggaagcgggtgatccagctgagccgcaagacgttcgacaccgagtaccagaagaccaagaacaacgactgggactacgtcgtgaccacggacatctccgagatgggcgcgaacttccgggccgaccgcgtgatcgacccccggcgctgcctcaagcccgtcatcctgaaggacgggcccgagcgggtgatcctggccggcccgatgcccgtcaccgtggccagcgcggcccagcgccggggccgcatcgggcgcaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgggagaagtccgcggccatcgacggggagtaccgcctgcggggcgaggcccgcaagacgttcgtcgagctgatgcggcgcggcgacctccccgtgtggctgagctacaaggtggcctccgaggggttccagtacagcgaccggcgctggtgcttcgacggcgagcggaacaaccaggtcctggaggagaacatggacgtggagatctggaccaaggagggggagcgcaagaagctccggccccgctggctggacgcccggacctactccgacccgctggcgctccgcgagttcaaggagttcgccgccggccggcgcagcgtgagcggcgacctgatcctggagatcgggaagctcccccagcacctgaccctgcgggcccagaacgccctcgacaacctggtcatgctgcacaactccgagcagggcgggaaggcgtaccgccacgccatggaggagctccccgacaccatcgagacgctgatgctgctcgccctgatcgccgtgctgaccggcggggtgaccctcttcttcctgagcggcaagggcctggggaagacctccatcggcctcctgtgcgtcacggcgagctccgccctgctctggatggccagcgtggagccccactggatcgccgcctccatcatcctggagttcttcctgatggtgctcctgatcccggagcccgaccggcagcgcacgccccaggacaaccagctggcgtacgtcgtgatcgggctcctgttcatgatcctgaccgtggccgccaacgagatgggcctcctggagaccacgaagaaggacctggggatcggctacgtcgccgccgagaaccaccagcacgcgaccatgctcgacgtggacctgcacccggccagcgcctggaccctgtacgccgtggccaccacggtcatcacccccatgatgcggcacaccatcgagaacaccacggcgaacatctccctcaccgccatcgccaaccaggccgccatcctgatgggcctggacaaggggtggcccatcagcaagatggacatcggcgtgcccctcctggcgctggggtgctactcccaggtgaacccgctcaccctgaccgccgccgtcctgatgctcgtggcccactacgcgatcatcggccccgggctgcaggccaaggccacgcgcgaggcccagaagcgcaccgccgcgggcatcatgaagaaccccaccgtggacggcatcgtcgccatcgacctggaccccgtggtgtacgacgccaagttcgagaagcagctcgggcagatcatgctgctgatcctctgcaccagccagatcctgctgatgcggacgacctgggccctctgcgagtccatcaccctggccaccggcccgctgacgaccctctgggaggggagccccggcaagttctggaacaccaccatcgcggtctccatggccaacatcttccgcggcagctacctggccggggccggcctggccttctccctcatgaagtccctcgggggcgggcggcgcgggacgggcgcgcagggggagaccctgggcgagaagtggaagcggcagctcaaccagctgtccaagagcgagttcaacacctacaagcgcagcgggatcatggaggtggaccggtccgaggccaaggagggcctgaagcgcggggagaccacgaagcacgccgtgagccggggcaccgccaagctccgctggttcgtcgagcggaacctggtgaagcccgagggcaaggtgatcgacctggggtgcggccgcgggggctggtcctactactgcgcggggctgaagaaggtcaccgaggtgaagggctacaccaagggcgggcccggccacgaggagccgatccccatggccacctacgggtggaacctcgtgaagctgcacagcggcaaggacgtcttcttcatgccgcccgagaagtgcgacacgctgctctgcgacatcggggagtccagcccgaaccccaccatcgaggagggccggaccctgcgcgtgctgaagatggtggagccctggctccggggcaaccagttctgcatcaagatcctgaacccctacatgccgtccgtcgtggagaccctggagcagatgcagcgcaagcacgggggcatgctcgtgcggaaccccctgagccgcaactccacgcacgagatgtactgggtcagctgcgggaccggcaacatcgtgtccgccgtgaacatgaccagccggatgctgctcaaccgcttcaccatggcccaccgcaagcccacgtacgagcgggacgtcgacctgggcgccgggacccgccacgtggcggtggagcccgaggtcgccaacctggacatcatcggccagcggatcgagaacatcaagaacgagcacaagtccacctggcactacgacgaggacaacccgtacaagacctgggcctaccacgggagctacgaggtgaagccctccggcagcgcctccagcatggtcaacggggtggtgcgcctcctgacgaagccctgggacgtcatccccatggtgacccagatcgccatgaccgacaccacgccgttcggccagcagcgggtgttcaaggagaaggtcgacacccgcacgccccgggcgaagcgcggcaccacgcagatcatggaggtgaccgccaagtggctgtgggggttcctctcccggaacaagaagccccgcatctgcacccgggaggagttcacccgcaaggtgcggagcaacgccgccatcggcgccgtcttcgtggacgagaaccagtggaacagcgcgaaggaggccgtggaggacgagcgcttctgggacctggtccaccgggagcgcgagctgcacaagcaggggaagtgcgccacgtgcgtgtacaacatgatgggcaagcgggagaagaagctcggggagttcggcaaggccaagggctcccgcgcgatctggtacatgtggctgggggcccggttcctggagttcgaggccctcggcttcatgaacgaggaccactggttcagccgcgagaactccctgagcggggtggagggcgaggggctgcacaagctcggctacatcctgcgggacatctccaagatcccgggcgggaacatgtacgccgacgacaccgccggctgggacacccgcatcaccgaggacgacctgcagaacgaggcgaagatcacggacatcatggagcccgagcacgccctcctggccaccagcatcttcaagctgacctaccagaacaaggtcgtgcgcgtgcagcggcccgccaagaacgggaccgtcatggacgtgatctcccgccgggaccagcgcggcagcggccaggtggggacgtacggcctcaacaccttcaccaacatggaggtccagctgatccggcagatggagtccgaggggatcttcctgcccagcgagctcgagaccccgaacctggccgagcgcgcgctggactggctcgagaagcacggcgccgagcggctgaagcgcatggccatctccggggacgactgcgtggtgaagcccatcgacgaccggttcgccacggccctgaccgcgctcaacgacatgggcaaggtccgcaaggacatcccccagtgggagcccagcaagggctggaacgactggcagcaggtcccgttctgctcccaccacttccaccagctgatcatgaaggacgggcgggagatcgtggtcccctgccgcaaccaggacgagctggtgggccgggcccgcgtgagccagggggccggctggtccctccgggagaccgcctgcctgggcaagagctacgcccagatgtggcagctgatgtacttccaccgccgggacctccgcctggcggccaacgccatctgctccgccgtccccgtggactgggtgcccaccagccggaccacgtggagcatccacgcgcaccaccagtggatgaccaccgaggacatgctgtccgtctggaaccgcgtgtggatcgaggagaacccgtggatggaggacaagacccacgtgagctcctgggaggaggtcccctacctcggcaagcgcgaggaccagtggtgcggcagcctgatcgggctgacggcccgggccacctgggccaccaacatccaggtggccatcaaccaggtgcgccggctcatcggcaacgagaactacctggactacatgacctccatgaagcgcttcaagaacgagagcgaccccgagggggcgctgtggtga

SEQ ID NO: 8256 - RNA, 9879 nt, synthetic construct
  misc_feature 1..9879: note = derived and/or modified CDS sequence (opt1) from DENV-1__FJ850099__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacctacctggccctcatggccacgttcaagatgcgcccgatgttcgccgtggggctgctgttccggcgcctcaccagccgggaggtgctgctgctcaccatcggcctgtccctggtcgccagcgtggagctccccaactccctggaggagctgggggacggcctcgcgatgggcatcatgatgctgaagctgctcaccgagttccagccccaccagctgtggacgaccctgctcagcctgaccttcgtcaagaccacgctgtccctcgactacgcctggaagaccaccgccatggtgctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcacgatgaagatcaaggacgaggagcgggacgacaccctcaccatcctgctgaaggccaccctcctggccgtgtccggggtgtaccccatgagcatccccgcgacgctgttcgtctggtacttctggcagaagaagaagcagcgctccggcgtgctctgggacacccccagcccgcccgaggtggagcgggccgtcctggacgacggcatctaccgcatcctgcagcgggggctgctcggccgctcccaggtgggggtgggcgtcttccaggacggggtgttccacaccatgtggcacgtgacccggggcgccgtcctgatgtaccagggcaagcgcctggagcccagctgggcctccgtgaagaaggacctcatcagctacgggggcgggtggcggttccagggctcctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggaccagcggctccccgatcgtgaaccgcgagggcaagatcgtggggctgtacggcaacggggtcgtgaccaccagcggcacgtacgtgtccgccatcgcccaggccaaggcgagccaggaggggcccctccccgagatcgaggacgaggtcttcaagaagcggaacctgaccatcatggacctgcacccgggcagcggcaagacccgccggtacctccccgccatcgtgcgcgaggccatcaagcggaagctgcgcaccctgatcctcgcccccacgcgcgtggtcgcgtccgagatggccgaggccctgaaggggatgcccatccggtaccagaccaccgccgtcaagagcgagcacaccggccgcgagatcgtggacctgatgtgccacgccacgttcaccatgcggctcctgtccccggtccgcgtgcccaactacaacatgatcatcatggacgaggcgcacttcaccgaccccgccagcatcgccgcccgggggtacatctccacccgcgtgggcatgggggaggccgcggccatcttcatgacggccacgccgcccggcagcgtcgaggccttcccccagtccaacgccgtgatccaggacgaggagcgggacatccccgagcgcagctggaactccggctacgactggatcaccgacttccccgggaagaccgtgtggttcgtccccagcatcaagtccggcaacgacatcgcgaactgcctgcggaagaacgggaagcgcgtgatccagctcagccggaagacgttcgacaccgagtaccagaagaccaagaacaacgactgggactacgtggtcaccacggacatctccgagatgggcgccaacttccgcgccgaccgggtgatcgacccccgccggtgcctgaagcccgtgatcctgaaggacgggcccgagcgcgtcatcctcgccggcccgatgcccgtgaccgtcgcgagcgccgcccagcggcgcggccggatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagacgttcgtggagctcatgcgccggggcgacctgcccgtctggctgagctacaaggtggcctccgaggggttccagtacagcgaccgccggtggtgcttcgacggcgagcgcaacaaccaggtgctcgaggagaacatggacgtcgagatctggaccaaggagggggagcggaagaagctgcgcccccggtggctggacgcgcgcacctactccgacccgctcgccctgcgggagttcaaggagttcgccgccggccgccggagcgtgagcggcgacctgatcctcgagatcgggaagctgccccagcacctgaccctccgcgcccagaacgcgctggacaacctggtgatgctccacaactccgagcagggcgggaaggcctaccggcacgccatggaggagctgcccgacaccatcgagacgctgatgctcctggccctgatcgcggtcctcaccggcggggtgaccctgttcttcctgagcggcaagggcctcgggaagacctccatcggcctgctgtgcgtgacggccagctccgccctcctgtggatggccagcgtcgagccccactggatcgccgcgtccatcatcctggagttcttcctcatggtgctgctgatcccggagcccgaccgccagcggacgccccaggacaaccagctcgcctacgtggtcatcgggctgctgttcatgatcctcaccgtggccgccaacgagatgggcctgctggagaccacgaagaaggacctcgggatcggctacgtggccgcggagaaccaccagcacgccaccatgctggacgtcgacctgcgcccggccagcgcctggaccctctacgccgtggcgaccacggtgatcacccccatgatgcggcacaccatcgagaacaccacggccaacatctccctgaccgccatcgccaaccaggccgcgatcctgatgggcctcgacaaggggtggcccatcagcaagatggacatcggcgtccccctgctggccctcgggtgctactcccaggtgaacccgctgaccctgaccgccgccgtgctcatgctggtcgcgcactacgccatcatcggccccgggctgcaggccaaggccacgcgcgaggcccagaagcgcaccgcggccggcatcatgaagaaccccaccgtggacggcatcgtggccatcgacctcgaccccgtcgtgtacgacgccaagttcgagaagcagctggggcagatcatgctgctcatcctgtgcaccagccagatcctgctcatgcggacgacctgggccctgtgcgagtccatcaccctggcgaccggcccgctcacgaccctgtgggaggggagccccggcaagttctggaacaccaccatcgccgtgtccatggccaacatcttccgcggcagctacctggccggggccggcctcgcgttctccctgatgaagtccctcgggggcgggcggcgcgggacgggcgcccagggggagaccctcggcgagaagtggaagcggcagctgaaccagctgtccaagagcgagttcaacacctacaagcgcagcgggatcatggaggtcgaccggtccgaggccaaggagggcctcaagcgcggggagaccacgaagcacgccgtgagccggggcaccgcgaagctgcgctggttcgtggagcggaacctggtcaagcccgagggcaaggtgatcgacctggggtgcggccgcgggggctggtcctactactgcgccgggctcaagaaggtgaccgaggtcaagggctacaccaagggcgggcccggccacgaggagccgatccccatggccacctacgggtggaacctggtgaagctgcacagcggcaaggacgtgttcttcatgccgcccgagaagtgcgacacgctcctgtgcgacatcggggagtccagcccgaaccccaccatcgaggagggccggaccctgcgcgtcctcaagatggtggagccctggctgaagggcaaccagttctgcatcaagatcctgaacccctacatgccgtccgtggtcgagaccctcgagcagatgcagcggaagcacgggggcatgctggtgcgcaaccccctgagccggaactccacgcacgagatgtactgggtgagctgcgggaccggcaacatcgtctccgccgtgaacatgaccagccgcatgctcctgaaccggttcaccatggcccaccgcaagcccacgtacgagcgcgacgtggacctgggcgcggggacccggcacgtcgccgtggagcccgaggtggccaacctcgacatcatcggccagcgcatcgagaacatcaagaacgagcacaagtccacctggcactacgacgaggacaacccgtacaagacctgggcctaccacgggagctacgaggtcaagccctccggcagcgcctccagcatggtgaacggggtcgtgcggctgctgacgaagccctgggacgtgatccccatggtcacccagatcgcgatgaccgacaccacgccgttcggccagcagcgcgtgttcaaggagaaggtggacacccggacgccccgcgccaagcggggcaccacgcagatcatggaggtcaccgccaagtggctctgggggttcctgtcccgcaacaagaagccccggatctgcacccgcgaggagttcacccggaaggtgcgcagcaacgccgccatcggcgcggtgttcgtcgacgagaaccagtggaacagcgccaaggaggccgtggaggacgagcggttctgggacctggtgcaccgcgagcgggagctccacaagcaggggaagtgcgccacgtgcgtctacaacatgatgggcaagcgcgagaagaagctgggggagttcggcaaggcgaagggctcccgggccatctggtacatgtggctgggggcccgcttcctcgagttcgaggccctgggcttcatgaacgaggaccactggttcagccgggagaactccctgagcggggtggagggcgaggggctccacaagctgggctacatcctgcgcgacatctccaagatcccgggcgggaacatgtacgccgacgacaccgcgggctgggacacccggatcaccgaggacgacctccagaacgaggccaagatcacggacatcatggagcccgagcacgccctgctggccaccagcatcttcaagctcacctaccagaacaaggtggtccgcgtgcagcgccccgccaagaacgggaccgtgatggacgtcatctcccggcgcgaccagcggggcagcggccaggtggggacgtacggcctgaacaccttcaccaacatggaggtgcagctgatccgccagatggagtccgaggggatcttcctcagctccgagctggagacccccaacctggcggagcgggtcctcgactggctggagaagcacggcgccgagcgcctgaagcggatggccatcagcggggacgactgcgtggtgaagccgatcgacgaccgcttcgccacggccctcaccgcgctgaacgacatgggcaaggtccggaaggacatcccccagtgggagccctccaagggctggaacgactggcagcaggtccccttctgcagccaccacttccaccagctgatcatgaaggacgggcgcgagatcgtggtcccgtgccggaaccaggacgagctcgtgggccgcgcccgggtgtcccagggggccggctggagcctgcgcgagaccgcctgcctggggaagtcctacgcccagatgtggcagctcatgtacttccaccggcgcgacctgcggctggcggccaacgccatctgcagcgccgtccccgtggactgggtgcccaccagccgcaccacgtggtccatccacgcgcaccaccagtggatgaccaccgaggacatgctcagcgtctggaaccgggtgtggatcgaggagaacccctggatggaggacaagacccacgtgtccagctgggaggaggtcccgtacctgggcaagcgcgaggaccagtggtgcggctccctgatcgggctcacggcccgcgccacctgggccaccaacatccaggtggccatcaaccaggtgcggcgcctgatcggcaacgagaactacctggactacatgaccagcatgaagcggttcaagaacgagtccgaccccgagggggcgctctggtga

SEQ ID NO: 8257 - RNA, 9879 nt, synthetic construct
  misc_feature 1..9879: note = derived and/or modified CDS sequence (opt1) from DENV-1__FJ850100__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacccacctggccctcatggccacgttcaagatgcgcccgatgttcgccgtggggctgctgttccggcgcctcaccagccgggaggtgctgctgctcaccatcgggctgtccctgatggccagcatggagctccccaactccctggaggagctgggggacggcctcgcgatgggcatcatgatgctgaagctgctcaccgagttccagccccaccagctgtggacgaccctgctcagcctgaccttcgtcaagaccacgctgtccctcgactacgcctggaagaccaccgccatgatcctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcacgatgaagatcaaggacgaggagcgggacgacaccctcaccatcctgctgaaggccaccctcctggccgtgtccggggtgtaccccatgagcatccccgcgacgctgttcgtctggtacttctggcagaagaagaagcagcgctccggcgtgctctgggacacccccagcccgcccgaggtggagcgggccgtcctggacgacggcatctaccgcatcctgcagcgggggctgctcggccgctcccaggtgggggtgggcgtcttccaggacggggtgttccacaccatgtggcacgtgacccggggcgccgtcctgatgtaccagggcaagcgcctggagcccagctgggcctccgtgaagaaggacctcatcagctacgggggcgggtggcggttccagggctcctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggaccagcggctccccgatcgtgaaccgcgagggcaagatcgtggggctgtacggcaacggggtcgtgaccaccagcggcacgtacgtgtccgccatcgcccaggccaaggcgagccaggaggggcccctccccgagatcgaggacgaggtcttcaagaagcggaacctgaccatcatggacctgcacccgggcagcggcaagacccgccggtacctccccgccatcgtgcgcgaggccatcaagcggaagctgcgcaccctgatcctcgcccccacgcgcgtggtcgcgtccgagatggccgaggccctgaaggggatgcccatccggtaccagaccaccgccgtcaagagcgagcacaccggccgcgagatcgtggacctgatgtgccacgccacgttcaccatgcggctcctgtccccggtccgcgtgcccaactacaacatgatcatcatggacgaggcgcacttcaccgaccccgccagcatcgccgcccgggggtacatctccacccgcgtgggcatgggggaggccgcggccatcttcatgacggccacgccgcccggcagcgtcgaggccttcccccagtccaacgccgtgatccaggacgaggagcgggacatccccgagcgcagctggaactccggctacgactggatcaccgacttccccgggaagaccgtgtggttcgtccccagcatcaagtccggcaacgacatcgcgaactgcctgcggaagaacgggaagcgcgtgatccagctcagccggaagacgttcgacaccgagtaccagaagaccaagaacaacgactgggactacgtggtcaccacggacatctccgagatgggcgccaacttccgcgccgaccgggtgatcgacccccgccggtgcctgaagcccgtgatcctgaaggacgggcccgagcgcgtcatcctcgccggcccgatgcccgtgaccgtggcgagcgccgcccagcggcgcggccggatcgggcgcaaccagaacaaggagggcgaccagtacgtctacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagacgttcgtggagctcatgcgccggggcgacctgcccgtctggctgagctacaaggtggcctccgaggggttccagtacagcgaccgccggtggtgcttcgacggcgagcgcaacaaccaggtgctcgaggagaacatggacgtcgagatctggaccaaggagggggagcggaagaagctgcgcccccggtggctggacgcgcgcacctactccgacccgctcgccctgcgggagttcaaggagttcgccgccggccgccggagcgtgagcggcgacctgatcctcgagatcgggaagctgccccagcacctgaccctccgcgcccagaacgcgctggacaacctggtgatgctccacaactccgagcagggcgggaaggcctaccggcacgccatggaggagctgcccgacaccatcgagacgctgatgctcctggccctgatcgcggtcctcaccggcggggtgaccctgttcttcctgagcggcaagggcctcgggaagacctccatcggcctgctgtgcgtgacggccagctccaccctcctgtggatggccagcgtcgagccccactggatcgccgcctccatcatcctggagttcttcctcatggtgctgctgatcccggagcccgaccgccagcggacgccccaggacaaccagctcgcgtacgtggtcatcgggctgctgttcatgatcctcaccgtggccgccaacgagatgggcctgctggagacgaccaagaaggacctcgggatcggctacgtggccgccgagaaccaccagcacgcgaccatgctggacgtcgacctgcgcccggccagcgcctggaccctctacgccgtggccacgaccgtgatcacccccatgatgcggcacaccatcgagaacacgaccgcgaacatctccctgaccgccatcgccaaccaggccgccatcctgatgggcctcgacaaggggtggcccatcagcaagatggacatcggcgtccccctgctggcgctcgggtgctactcccaggtgaacccgctgaccctgacggccgccgtgctcatgctggtcgcccactacgcgatcatcggccccgggctgcaggccaaggccacccgcgaggcccagaagcgcaccgccgcgggcatcatgaagaaccccaccgtggacggcatcgtggccatcgacctcgaccccgtcgtgtacgacgccaagttcgagaagcagctggggcagatcatgctgctcatcctgtgcacgagccagatcctgctcatgcggaccacctgggccctgtgcgagtccatcaccctggccacgggcccgctcaccaccctgtgggaggggagccccggcaagttctggaacaccacgatcgcggtgtccatggccaacatcttccgcggcagctacctggccggggccggcctcgccttctccctgatgaagtccctcgggggcgggcggcgcgggaccggcgcgcagggggagaccctcggcgagaagtggaagcggcagctgaaccagctgtccaagagcgagttcaacacctacaagcgcagcgggatcatggaggtcgaccggtccgaggccaaggagggcctcaagcgcggggagacgaccaagcacgccgtgagccggggcaccgccaagctgcgctggttcgtggagcggaacctggtcaagcccgagggcaaggtgatcgacctggggtgcggccgcgggggctggtcctactactgcgcggggctcaagaaggtgaccgaggtcaagggctacaccaagggcgggcccggccacgaggagccgatccccatggccacgtacgggtggaacctggtgaagctgcacagcggcaaggacgtgttcttcatgccgcccgagaagtgcgacaccctcctgtgcgacatcggggagtccagcccgaaccccaccatcgaggagggccggaccctgcgcgtcctcaagatggtggagccctggctgaagggcaaccagttctgcatcaagatcctgaacccctacatgccgtccgtggtcgagacgctcgagcagatgcagcggaagcacgggggcatgctggtgcgcaaccccctgagccggaactccacccacgagatgtactgggtgagctgcgggaccggcaacatcgtctccgccgtgaacatgaccagccgcatgctcctgaaccggttcacgatggcccaccgcaagcccacctacgagcgcgacgtggacctgggcgccgggacccggcacgtcgcggtggagcccgaggtggccaacctcgacatcatcggccagcgcatcgagaacatcaagaacgagcacaagtccacctggcactacgacgaggacaacccgtacaagacgtgggcctaccacgggagctacgaggtcaagccctccggcagcgcctccagcatggtgaacggggtggtccggctgctgaccaagccctgggacgtgatccccatggtcacccagatcgccatgaccgacacgaccccgttcggccagcagcgcgtgttcaaggagaaggtggacacccggacgccccgcgcgaagcggggcacgacccagatcatggaggtcaccgccaagtggctctgggggttcctgtcccgcaacaagaagccccggatctgcacccgcgaggagttcacgcggaaggtgcgcagcaacgccgccatcggcgccgtgttcgtcgacgagaaccagtggaacagcgcgaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaagggctcccgggcgatctggtacatgtggctgggggcccgcttcctcgagttcgaggccctgggcttcatgaacgaggaccactggttcagccgggagaactccctgagcggggtggagggcgaggggctccacaagctgggctacatcctgcgcgacatctccaagatcccgggcgggaacatgtacgccgacgacaccgccggctgggacacccggatcacggaggacgacctccagaacgaggcgaagatcaccgacatcatggagcccgagcacgccctgctggccaccagcatcttcaagctcacctaccagaacaaggtggtccgcgtgcagcgccccgccaagaacgggacggtgatggacgtcatctcccggcgcgaccagcggggcagcggccaggtggggacctacggcctgaacaccttcaccaacatggaggtgcagctgatccgccagatggagtccgaggggatcttcctccccagcgagctggagacgccgaacctggccgagcgggtcctcgactggctggagaagcacggcgcggagcgcctgaagcggatggccatctccggggacgactgcgtggtgaagcccatcgacgaccgcttcgccaccgccctcaccgccctgaacgacatgggcaaggtccggaaggacatcccccagtgggagcccagcaagggctggaacgactggcagcaggtcccgttctgctcccaccacttccaccagctgatcatgaaggacgggcgcgagatcgtggtcccctgccggaaccaggacgagctcgtgggccgcgcgcgggtgagccagggggccggctggtccctgcgcgagaccgcctgcctgggcaagagctacgcccagatgtggcagctcatgtacttccaccggcgcgacctgcggctggccgcgaacgccatctgctccgccgtccccgtggactgggtgcccaccagccgcacgacctggagcatccacgcccaccaccagtggatgaccaccgaggacatgctctccgtctggaaccgggtgtggatcgaggagaacccgtggatggaggacaagacgcacgtgagctcctgggaggaggtcccctacctgggcaagcgcgaggaccagtggtgcggcagcctgatcgggctcaccgcgcgcgccacctgggccaccaacatccaggtggccatcaaccaggtgcggcgcctgatcggcaacgagaactacctggactacatgacgtccatgaagcggttcaagaacgagagcgaccccgagggggccctctggtga

SEQ ID NO: 8258 - RNA, 9879 nt, synthetic construct
  misc_feature 1..9879: note = derived and/or modified CDS sequence (opt1) from DENV-1__FJ882579__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccgcaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagaaggggagctccatcggcaagatgttcgaggccaccgcccgcggggcccggcgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcacgcaggggaagaagatgatccggccccagcccatggagcacaagtactcctggaagtcctggggcaaggcgaagatcatcggcgccgacatccagaacaccaccttcatcatcgacgggcccgacaccccggagtgccccgacggccagcgcgcctggaacatctgggaggtcgaggactacgggttcggcatcttcacgaccaacatctggctgaagctgcgggactcctacacccagatgtgcgaccaccgcctcatgagcgccgcgatcaaggactccaaggccgtgcacgccgacatgggctactggatcgagagcgagaagaacgagacctggaagctggcccgggcctccttcatcgaggtgaagacgtgcacctggcccaagagccacaccctgtggtccaacggggtcctcgagagcgagatgatcatccccaagatctacggcgggccgatctcccagcacaactaccgccccggctacttcacccagacggcggggccctggcacctgggcaagctggagctcgacttcgacctgtgcgagggcaccaccgtggtggtcgacgagcactgcgggaaccggggcccgagcctgcgcaccacgaccgtgaccgggaagatcatccacgagtggtgctgccggtcctgcaccctgccgcccctgcgcttccggggcgaggacgggtgctggtacggcatggagatccgccccgtgaaggagaaggaggagaacctggtccggagcatggtgtccgccggcagcggggaggtggacagcttctccctcggcatcctgtgcgtcagcatcatgatcgaggaggtgatgcgctcccggtggagccgcaagatgctgatgacggggaccctcgccgtgttcctgctgctcatcatgggccagctgacctggaacgacctgatccgcctctgcatcatggtcggggccaacgcctccgaccggatgggcatgggcaccacgtacctggcgctgatggccaccttcaagatgcgcccgatgttcgccgtggggctcctgttccggcgcctgaccagccgggaggtgctcctgctgaccatcggcctctccctggtcgccagcgtggagctgcccaactccctcgaggagctgggggacggcctggccatgggcatcatgatgctcaagctgctgacggagttccagccccaccagctctggaccaccctgctgagcctcaccttcgtcaagacgaccctgtccctggactacgcgtggaagaccaccgccatggtgctcagcatcgtgtccctgttccccctgtgcctcagcacgacctcccagaagaccacctggctgccggtcctgctcgggagcttcggctgcaagcccctgaccatgttcctgatcacggagaacaagatctgggggcgcaagtcctggcccctcaacgagggcatcatggccatcgggatcgtgagcatcctgctgtccagcctcctgaagaacgacgtgcccctggccggcccgctcatcgcgggcgggatgctgatcgcctgctacgtcatcagcggctccagcgccgacctgctcctggagaaggccgccgaggtgtcctgggagcaggaggcggagcacagcggggcctcccacaacatcctggtggaggtccaggacgacggcaccatgaagatcaaggacgaggagcgggacgacaccctcaccatcctgctgaaggccacgctcctggccgtgagcggggtgtaccccatgtccatccccgccaccctgttcgtctggtacttctggcagaagaagaagcagcgcagcggcgtgctctgggacaccccctccccgcccgaggtggagcgggcggtcctggacgacggcatctaccgcatcctgcagcgggggctgctcggccgcagccaggtgggggtgggcgtcttccaggacggggtgttccacaccatgtggcacgtgacgcggggcgccgtcctgatgtaccagggcaagcgcctggagccctcctgggccagcgtgaagaaggacctcatctcctacgggggcgggtggcggttccagggcagctggaacaccggggaggaggtgcaggtcatcgccgtggagcccggcaagaacccgaagaacgtgcagaccacccccggcacgttcaagacccccgagggggaggtcggcgccatcgcgctggacttcaagcccgggacctccggcagcccgatcgtgaaccgcgagggcaagatcgtggggctgtacggcaacggggtcgtgaccacgtccggcacctacgtgagcgccatcgcccaggccaaggcctcccaggaggggcccctccccgagatcgaggacgaggtcttcaagaagcggaacctgaccatcatggacctgcacccgggcagcggcaagacccgccggtacctccccgcgatcgtgcgcgaggccatcaagcggaagctgcgcacgctgatcctcgcccccacccgcgtggtcgccagcgagatggcggaggccctgaaggggatgcccatccggtaccagaccaccgccgtgaagtccgagcacacgggccgcgagatcgtggacctgatgtgccacgccaccttcaccatgcggctcctgagcccggtccgcgtgcccaactacaacatgatcatcatggacgaggcccacttcaccgaccccgcgtccatcgccgcccgggggtacatcagcacgcgcgtgggcatgggggaggccgccgcgatcttcatgaccgccacgccgcccggctccgtcgaggccttcccccagagcaacgccgtgatccaggacgaggagcgggacatccccgagcgctcctggaacagcggctacgactggatcaccgacttccccgggaagacggtgtggttcgtcccctccatcaagagcggcaacgacatcgccaactgcctgcggaagaacgggaagcgcgtgatccagctctcccggaagaccttcgacaccgagtaccagaagaccaagaacaacgactgggactacgtggtcacgaccgacatcagcgagatgggcgcgaacttccgcgccgaccgggtgatcgacccccgccggtgcctgaagcccgtgatcctgaaggacgggcccgagcgcgtcatcctcgccggcccgatgcccgtgaccgtcgcctccgcggcccagcggcgcggccggatcgggcgcaaccagaacaaggagggcgaccagtacgtgtacatggggcagcccctgaacaacgacgaggaccacgcccactggaccgaggccaagatgctgctcgacaacatcaacacgcccgagggcatcatcccggccctgttcgagcccgagcgcgagaagtccgcggccatcgacggggagtaccggctgcgcggcgaggcccggaagaccttcgtggagctcatgcgccggggcgacctgcccgtctggctgtcctacaaggtggccagcgaggggttccagtactccgaccgccggtggtgcttcgacggcgagcgcaacaaccaggtgctcgaggagaacatggacgtcgagatctggaccaaggagggggagcggaagaagctgcgcccccggtggctggacgcccgcacctacagcgacccgctcgcgctgcgggagttcaaggagttcgccgccggccgccggtccgtgagcggcgacctgatcctcgagatcgggaagctgccccagcacctgaccctccgcgcccagaacgccctggacaacctggtgatgctccacaacagcgagcagggcgggaaggcgtaccggcacgccatggaggagctgcccgacacgatcgagaccctgatgctcctggccctgatcgccgtcctcaccggcggggtgaccctgttcttcctgtccggcaagggcctcgggaagacgagcatcggcctgctgtgcgtgaccgcgtccagcgccctcctgtggatggcctccgtcgagccccactggatcgccgccagcatcatcctggagttcttcctcatggtgctgctgatcccggagcccgaccgccagcggacgccccaggacaaccagctcgcgtacgtggtcatcgggctgctgttcatgatcctcaccgtggccgccaacgagatgggcctgctggagacgaccaagaaggacctcgggatcggctacgtggccgccgagaaccaccagcacgcgaccatgctggacgtcgacctgcgcccggcctccgcctggaccctctacgccgtggccacgaccgtgatcacccccatgatgcggcacaccatcgagaacacgaccgcgaacatcagcctgaccgccatcgccaaccaggccgccatcctgatgggcctcgacaaggggtggcccatctccaagatggacatcggcgtccccctgctggcgctcgggtgctacagccaggtgaacccgctgaccctgacggccgccgtgctcatgctggtcgcccactacgcgatcatcggccccgggctgcaggccaaggccacccgcgaggcccagaagcgcaccgccgcgggcatcatgaagaaccccaccgtggacggcatcgtggccatcgacctcgaccccgtcgtgtacgacgccaagttcgagaagcagctggggcagatcatgctgctcatcctgtgcacgtcccagatcctgctcatgcggaccacctgggccctgtgcgagagcatcaccctggccacgggcccgctcaccaccctgtgggaggggtcccccggcaagttctggaacaccacgatcgcggtgagcatggccaacatcttccgcggctcctacctggccggggccggcctcgccttcagcctgatgaagtccctcgggggcgggcggcgcggcaccggcgcgcagggggagaccctcggcgagaagtggaagcggcagctgaaccagctgagcaagtccgagttcaacacctacaagcgcagcgggatcatggaggtcgaccggagcgaggccaaggagggcctcaagcgcggggagacgaccaagcacgccgtgtcccggggcaccgccaagctgcgctggttcgtggagcggaacctggtcaagcccgagggcaaggtgatcgacctggggtgcggccgcgggggctggagctactactgcgcggggctcaagaaggtgaccgaggtcaagggctacaccaagggcgggcccggccacgaggagccgatccccatggccacgtacgggtggaacctggtgaagctgcactccggcaaggacgtgttcttcatgccgcccgagaagtgcgacaccctcctgtgcgacatcggggagagctccccgaaccccaccatcgaggagggccggaccctgcgcgtcctcaagatggtggagccctggctgaagggcaaccagttctgcatcaagatcctgaacccctacatgccgagcgtggtcgagacgctcgagcagatgcagcggaagcacgggggcatgctggtgcgcaaccccctgtcccggaacagcacccacgagatgtactgggtgtcctgcgggaccggcaacatcgtcagcgccgtgaacatgacctcccgcatgctcctgaaccggttcacgatggcccaccgcaagcccacctacgagcgcgacgtggacctgggcgccgggacccggcacgtcgcggtggagcccgaggtggccaacctcgacatcatcggccagcgcatcgagaacatcaagaacgagcacaagagcacctggcactacgacgaggacaacccgtacaagacgtgggcctaccacgggtcctacgaggtcaagcccagcggctccgccagctccatggtgaacggggtcgtgcggctgctgaccaagccctgggacgtgatccccatggtcacccagatcgccatgaccgacacgaccccgttcggccagcagcgcgtgttcaaggagaaggtggacacccggacgccccgcgcgaagcggggcacgacccagatcatggaggtcaccgccaagtggctctgggggttcctgagccgcaacaagaagccccggatctgcacccgcgaggagttcacgcggaaggtgcgctccaacgccgccatcggcgccgtgttcgtcgacgagaaccagtggaacagcgcgaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaagggcagccgggcgatctggtacatgtggctgggggcccgcttcctcgagttcgaggccctgggcttcatgaacgaggaccactggttctcccgggagaacagcctgtccggggtggagggcgaggggctccacaagctgggctacatcctgcgcgacatcagcaagatcccgggcgggaacatgtacgccgacgacaccgccggctgggacacccggatcacggaggacgacctccagaacgaggcgaagatcaccgacatcatggagcccgagcacgccctgctggccacctccatcttcaagctcacctaccagaacaaggtggtccgcgtgcagcgccccgccaagaacgggacggtgatggacgtcatcagccggcgcgaccagcggggctccggccaggtggggacctacggcctgaacaccttcaccaacatggaggtgcagctgatccgccagatggagagcgaggggatcttcctcccctccgagctggagacgccgaacctggccgagcgggtcctcgactggctggagaagcacggcgcggagcgcctgaagcggatggccatcagcggggacgactgcgtggtgaagcccatcgacgaccgcttcgccaccgccctcaccgccctgaacgacatgggcaaggtccggaaggacatcccccagtgggagccctccaagggctggaacgactggcagcaggtcccgttctgcagccaccacttccaccagctgatcatgaaggacgggcgcgagatcgtggtcccctgccggaaccaggacgagctcgtgggccgcgcgcgggtgtcccagggggccggctggagcctgcgcgagaccgcctgcctggggaagtcctacgcccagatgtggcagctcatgtacttccaccggcgcgacctgcggctggccgcgaacgccatctgcagcgccgtccccgtggactgggtgcccacctcccgcacgacctggagcatccacgcccaccaccagtggatgaccaccgaggacatgctcagcgtctggaaccgggtgtggatcgaggagaacccgtggatggaggacaagacgcacgtgtccagctgggaggaggtcccctacctgggcaagcgcgaggaccagtggtgcggctccctgatcgggctcaccgcgcgcgccacctgggccaccaacatccaggtggccatcaaccaggtgcggcgcctgatcggcaacgagaactacctggactacatgacgagcatgaagcggttcaagaacgagtccgaccccgagggggccctctggtga

SEQ ID NO: 8259 - RNA, 9879 nt, synthetic construct
  misc_feature 1..9879: note = derived and/or modified CDS sequence (opt1) from DENV-1__JN819414__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccacccggggttcacggtgatcgccctgttcctcgcgtacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacctacctggccctcatggccacgttcaagatgcgcccgatgttcgccgtggggctgctgttccggcgcctcaccagccgggaggtgctgctgctcaccatcgggctgtccctggtcgccagcgtggagctccccaactccctggaggagctgggggacggcctcgcgatgggcatcatgatgctgaagctgctcaccgagttccagccccaccagctgtggacgaccctgctcagcctgaccttcgtcaagaccacgctgtccctcgactacgcctggaagaccaccgccatggtgctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctcctgctggagaaggccgcggaggtgtcctgggagcaggaggccgagcacagcggggcctcccacaacatcctcgtggaggtccaggacgacggcacgatgaagatcaaggacgaggagcgggacgacaccctgaccatcctgctcaaggccaccctgctggccgtgagcggggtgtaccccatgtccatccccgcgaccctcttcgtctggtacttctggcagaagaagaagcagcgcagcggcgtgctgtgggacaccccctccccgcccgaggtggagcgggccgtcctggacgacggcatctaccgcatcctgcagcgggggctcctgggccgcagccaggtgggggtgggcgtcttccaggacggggtgttccacaccatgtggcacgtgacccggggcgccgtcctgatgtaccagggcaagcgcctcgagccctcctgggccagcgtgaagaaggacctgatctcctacgggggcgggtggcggttccagggcagctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggacctccggcagcccgatcgtgaaccgcgagggcaagatcgtggggctctacggcaacggggtcgtgaccaccggcgggacgtacgtgtccgccatcgcccaggccaaggcgagccaggagggccccctgcccgagatcgaggacgaggtcttcaagaagcggaacctgaccatcatggacctccacccgggctccgggaagacccgccggtacctgcccgccatcgtgcgcgaggccatcaagcggaagctgcgcaccctcatcctggcccccacgcgcgtggtcgcgagcgagatggccgaggccctgaagggcatgcccatccggtaccagaccaccgccgtcaagagcgagcacaccgggcgcgagatcgtggacctcatgtgccacgccacgttcaccatgcggctgctgtccccggtccgcgtgcccaactacaacatgatcatcatggacgaggcgcacttcaccgaccccgccagcatcgccgcccggggctacatctccacccgcgtggggatgggcgaggccgcggccatcttcatgacggccacgccgcccggcagcgtcgaggccttcccccagtccaacgccgtgatccaggacgaggagcgggacatccccgagcgcagctggaactccgggtacgactggatcaccgacttccccggcaagaccgtgtggttcgtccccagcatcaagtccgggaacgacatcgcgaactgcctccggaagaacggcaagcgcgtgatccagctgagccggaagacgttcgacaccgagtaccagaagaccaagaacaacgactgggactacgtggtcaccacggacatctccgagatgggggccaacttccgcgccgaccgggtgatcgacccccgccggtgcctgaagcccgtgatcctcaaggacggccccgagcgcgtcatcctggccggcccgatgcccgtgaccgtcgcgagcgccgcccagcggcgcgggcggatcggccgcaaccagaacaaggagggggaccagtacgtgtacatgggccagcccctgaacaacgacgaggaccacgcccactggaccgaggccaagatgctcctggacaacatcaacacccccgaggggatcatcccggcgctgttcgagcccgagcgcgagaagtccgccgccatcgacggcgagtaccggctccgcggcgaggcccggaagacgttcgtggagctgatgcgccgcggggacctgcccgtctggctcagctacaaggtggcctccgagggcttccagtacagcgaccgccggtggtgcttcgacggggagcgcaacaaccaggtgctggaggagaacatggacgtcgagatctggaccaaggagggcgagcggaagaagctgcgcccccggtggctcgacgcgcgcacctactccgacccgctggccctgcgggagttcaaggagttcgccgccggccgccggagcgtgtccggggacctcatcctggagatcggcaagctgccccagcacctcaccctgcgcgcccagaacgcgctggacaacctcgtgatgctgcacaacagcgagcagggcgggaaggcctaccggcacgccatggaggagctgcccgacaccatcgagacgctcatgctgctggccctcatcgcggtcctgaccgggggcgtgaccctgttcttcctcagcggcaaggggctgggcaagacctccatcgggctgctctgcgtgacggccagctccgccctgctgtggatggccagcgtcgagccccactggatcgccgcgtccatcatcctcgagttcttcctgatggtgctgctcatcccggagcccgaccgccagcggacgccccaggacaaccagctggcctacgtggtcatcggcctcctcttcatgatcctgaccgtggccgccaacgagatggggctgctcgagaccacgaagaaggacctgggcatcggctacgtggccgcggagaaccaccagcacgccaccatgctggacgtcgacctccgcccggccagcgcctggaccctgtacgccgtggcgaccacggtgatcacccccatgatgcggcacaccatcgagaacaccacggccaacatctccctgaccgccatcgccaaccaggccgcgatcctcatggggctggacaagggctggcccatcagcaagatggacatcggggtccccctgctcgccctgggctgctactcccaggtgaacccgctgaccctcaccgccgccgtgctgatgctggtcgcgcactacgccatcatcgggcccggcctccaggccaaggccacgcgcgaggcccagaagcgcaccgcggccggcatcatgaagaaccccaccgtggacgggatcgtggccatcgacctggaccccgtcgtgtacgacgccaagttcgagaagcagctgggccagatcatgctcctgatcctgtgcaccagccagatcctcctgatgcggacgacctgggccctgtgcgagtccatcaccctcgcgaccgggccgctgacgaccctgtgggagggcagccccggcaagttctggaacaccaccatcgccgtgtccatggccaacatcttccgcgggagctacctcgccggcgccgggctggcgttctccctgatgaagtccctcggcgggggccggcgcggcacgggggcccagggcgagaccctgggggagaagtggaagcggcagctgaaccagctctccaagagcgagttcaacacctacaagcgctccggcatcatggaggtcgaccggagcgaggccaaggaggggctgaagcgcggcgagaccacgaagcacgccgtgagccggggcaccgcgaagctgcgctggttcgtggagcggaacctggtcaagcccgaggggaaggtgatcgacctcggctgcgggcgcggcgggtggtcctactactgcgccggcctgaagaaggtgaccgaggtcaagggctacaccaagggcgggcccgggcacgaggagccgatccccatggccacctacggctggaacctggtgaagctccacagcgggaaggacgtgttcttcatgccgcccgagaagtgcgacacgctgctgtgcgacatcggcgagtccagcccgaaccccaccatcgaggagggccggaccctccgcgtcctgaagatggtggagccctggctgaaggggaaccagttctgcatcaagatcctcaacccctacatgccgtccgtggtcgagaccctggagcagatgcagcggaagcacggcgggatgctggtgcgcaaccccctcagccggaactccacgcacgagatgtactgggtgagctgcggcaccggcaacatcgtctccgccgtgaacatgaccagccgcatgctgctgaaccggttcaccatggcccaccgcaagcccacgtacgagcgcgacgtggacctcggggcgggcacccggcacgtcgccgtggagcccgaggtggccaacctggacatcatcgggcagcgcatcgagaacatcaagaacgagcacaagtccacctggcactacgacgaggacaacccgtacaagacctgggcctaccacggcagctacgaggtcaagccctccgggagcgcctccagcatggtgaacggcgtcgtgcggctgctcacgaagccctgggacgtgatccccatggtcacccagatcgcgatgaccgacaccacgccgttcggccagcagcgcgtgttcaaggagaaggtggacacccggacgccccgcgccaagcgggggaccacgcagatcatggaggtcaccgccaagtggctgtggggcttcctgtcccgcaacaagaagccccggatctgcacccgcgaggagttcacccggaaggtgcgcagcaacgccgccatcggggcggtgttcgtcgacgagaaccagtggaacacggccaaggaggccgtggaggacgagcggttctgggacctcgtgcaccgcgagcgggagctgcacaagcagggcaagtgcgcgacctgcgtctacaacatgatggggaagcgcgagaagaagctgggcgagttcggcaaggcgaaggggtcccgggccatctggtacatgtggctcggcgcccgcttcctggagttcgaggccctggggttcatgaacgaggaccactggttcagccgggagaacagcctctccggcgtggagggggagggcctgcacaagctgggctacatcctccgcgacatcagcaagatccccggcgggaacatgtacgccgacgacaccgcggggtgggacacccggatcacggaggacgacctgcagaacgaggccaagatcaccgacatcatggagcccgagcacgccctgctcgccacctccatcttcaagctgacctaccagaacaaggtggtccgcgtgcagcgccccgccaagaacgggacggtgatggacgtcatcagccggcgcgaccagcggggctccggccaggtgggcacctacgggctgaacaccttcaccaacatggaggtgcagctcatccgccagatggagagcgagggcatcttcctgccctccgagctggagacgccgaacctcgcggagcgggccctggactggctggagaagcacggggccgagcgcctcaagcggatggccatcagcggcgacgactgcgtcgtgaagcccatcgacgaccgcttcgccaccgcgctgaccgccctgaacgacatgggcaaggtgcggaaggacatcccccagtgggagccctccaaggggtggaacgactggcagcaggtcccgttctgcagccaccacttccaccagctcatcatgaaggacggccgcgagatcgtggtgccctgccggaaccaggacgagctggtcgggcgcgcccgggtgtcccagggcgccgggtggagcctgcgcgagaccgcctgcctcggcaagtcctacgcgcagatgtggcagctgatgtacttccaccggcgcgacctgcggctcgccgccaacgccatctgcagcgcggtgcccgtcgactgggtgcccacctcccgcacgacctggagcatccacgcccaccaccagtggatgaccaccgaggacatgctgtccgtgtggaaccgggtctggatcgaggagaacccgtggatggaggacaagacgcacgtgagcagctgggaggaggtgccctacctgggcaagcgcgaggaccagtggtgcgggtccctcatcggcctgaccgcccgcgccacctgggccaccaacatccaggtcgcgatcaaccaggtgcggcgcctgatcgggaacgagaactacctcgactacatgacgagcatgaagcggttcaagaacgagtccgaccccgagggcgccctgtggtga

SEQ ID NO: 8260 - RNA, 9879 nt, synthetic construct
  misc_feature 1..9879: note = derived and/or modified CDS sequence (opt1) from DENV-1__FJ873810__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgtgggggtgaacatgtgcaccctgatcgcgatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtcggcctggggctcgagacccgcaccgagacctggatgagctccgagggcgcctggaagcagatccagcgggtggagacctgggccctgcgccaccccgggttcacggtgatcgccttcttcctggcccacgcgatcggcaccagcatcacccagaaggggatcatcttcatcctcctgatgctggtgaccccctccatggccatgcggtgcgtgggcatcggcaaccgcgacttcgtggaggggctcagcggcgccacgtgggtcgacgtggtgctggagcacgggtcctgcgtcaccaccatggccaagaacaagcccaccctggacatcgagctcctgaagacggaggtgaccaaccccgccgtgctgcggaagctctgcatcgaggcgaagatcagcaacaccaccacggactcccgctgcccgacccagggcgaggccaccctggtcgaggagcaggacgccaacttcgtgtgccggcgcaccttcgtggaccggggctgggggaacggctgcgggctgttcggcaaggggagcctcctgacgtgcgccaagttcaagtgcgtcaccaagctggagggcaagatcgtgcagtacgagaacctcaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctgaccctcgactgcagcccccggaccggcctggacttcaacgagatggtgctgctcacgatgaaggagaagtcctggctggtgcacaagcagtggttcctggacctcccgctgccctggacctccggggccagcaccagccaggagacctggaaccggcaggacctgctcgtcacgttcaagaccgcccacgccaagaagcaggaggtggtggtcctgggctcccaggagggcgcgatgcacaccgccctgaccggggccacggagatccagaccagcggcaccaccacgatcttcgccgggcacctcaagtgccgcctgaagatggacaagctgaccctcaagggcatgtcctacgtgatgtgcaccgggagcttcaagctggagaaggaggtggccgagacccagcacggcacggtcctggtccaggtgaagtacgagggcaccgacgcgccctgcaagatccccttctccacccaggacgagaagggggtcacccagaacggccggctgatcacggccaacccgatcgtgaccgacaaggagaagcccgtgaacatcgagaccgagccgcccttcggggagagctacatcgtcgtgggcgccggcgagaaggccctcaagctgtcctggttcaagcgcgggagctccatcggcaagatgttcgaggcgaccgcccgcggggcccgccgcatggccatcctgggcgacacggcctgggacttcgggagcatcggcggcgtgttcacctccgtcgggaagctcgtgcaccaggtgttcggcaccgcgtacggggtcctgttcagcggcgtgtcctggaccatgaagatcgggatcggcatcctgctcacgtggctgggcctgaacagccggtccaccagcctctccatgacctgcatcgccgtggggatggtcaccctgtacctgggcgtgatggtgcaggccgacagcgggtgcgtcatcaactggaagggccgcgagctcaagtgcgggtccggcatcttcgtgacgaacgaggtgcacacctggaccgagcagtacaagttccaggccgacagcccgaagcggctgagcgccgcgatcggcaaggcctgggaggagggggtctgcggcatccgctccgccacccggctggagaacatcatgtggaagcagatcagcaacgagctcaaccacatcctgctggagaacgacatgaagttcaccgtggtggtcggggacgccaacggcatcctcgcccaggggaagaagatgatccgcccccagcccatggagcacaagtactcctggaagtcctggggcaaggcgaagatcatcggcgccgacatccagaacacgaccttcatcatcgacgggcccgacaccccggagtgccccgacggccagcgggcctggaacatctgggaggtggaggactacgggttcggcgtgttcaccacgaacatctggctgaagctgcgcgactcctacacccagatgtgcgaccaccggctcatgagcgccgcgatcaaggactccaaggccgtccacgccgacatgggctactggatcgagagcgagaagaacgagacctggaagctggcccgcgcctccttcatcgaggtgaagacctgcacgtggcccaagagccacaccctgtggtccaacggggtgctcgagagcgagatgatcatccccaagatctacggcgggccgatctcccagcacaactaccggcccggctacttcacccagaccgcggggccctggcacctgggcaagctggagctcgacttcgacctgtgcgagggcacgaccgtcgtggtggacgagcactgcgggaaccgcggcccgagcctgcggaccaccacggtcaccgggaagatcatccacgagtggtgctgccgctcctgcaccctgccgcccctgcggttccgcggcgaggacgggtgctggtacggcatggagatccggcccgtgaaggagaaggaggagaacctggtgcgcagcatggtctccgccggcagcggggaggtggacagcttctccctcggcatcctgtgcgtgagcatcatgatcgaggaggtcatgcggtcccgctggagccgcaagatgctgatgaccgggacgctcgccgtgttcctgctgctcatcatgggccagctgacctggaacgacctgatccggctctgcatcatggtgggggccaacgcctccgaccgcatgggcatgggcaccacctacctggcgctgatggccacgttcaagatgcggccgatgttcgccgtcgggctcctgttccgccggctgaccagccgcgaggtgctcctgctgaccatcggcctctccctggtcgccagcgtggagctgcccaactccctcgaggagctgggggacggcctggccatgggcatcatgatgctcaagctgctgaccgagttccagccccaccagctctggacgaccctgctgagcctcaccttcgtgaagaccacgctgtccctggactacgcgtggaagaccaccgccatggtcctcagcatcgtgtccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggccatcgggatcgtcagcatcctgctgtccagcctcctgaagaacgacgtgcccctggccggcccgctcatcgcgggcgggatgctgatcgcctgctacgtgatcagcggctccagcgccgacctgtccctcgagaaggccgccgaggtcagctgggagcaggaggcggagcactccggggccagccacaacatcctggtggaggtgcaggacgacggcacgatgaagatcaaggacgaggagcgcgacgacaccctgaccatcctcctgaaggccaccctgctcgccgtctccggggtgtaccccatgagcatccccgccacgctgttcgtgtggtacttctggcagaagaagaagcagcggtccggcgtcctgtgggacacccccagcccgcccgaggtggagcgcgcggtgctcgacgacggcatctaccggatcctgcagcgcgggctgctgggccggtcccaggtcggggtgggcgtgttccaggacggggtcttccacaccatgtggcacgtgacccgcggcgccgtgctcatgtaccagggcaagcggctggagcccagctgggcctccgtcaagaaggacctgatcagctacgggggcgggtggcgcttccagggctcctggaacacgggggaggaggtccaggtgatcgccgtcgagcccggcaagaacccgaagaacgtgcagaccacccccggcaccttcaagacgcccgagggggaggtgggcgccatcgcgctcgacttcaagcccgggaccagcggctccccgatcgtcaaccgggagggcaagatcgtggggctgtacggcaacggggtggtcaccaccagcggcacgtacgtgtccgccatcgcccaggccaaggccagccaggaggggcccctgcccgagatcgaggacgaggtgttcaagaagcgcaacctcaccatcatggacctgcacccgggcagcggcaagacccggcgctacctgcccgcgatcgtccgggaggccatcaagcgcaagctccgcaccctgatcctggcccccacgcgggtggtggcctccgagatggcggaggccctcaaggggatgcccatccgctaccagaccaccgccgtcaagagcgagcacaccggccgggagatcgtggacctgatgtgccacgccacgttcaccatgcgcctgctctccccggtgcgggtccccaactacaacatgatcatcatggacgaggcccacttcaccgaccccgcgagcatcgccgcccgcgggtacatctccacccgggtgggcatgggggaggccgccgcgatcttcatgacggccacgccgcccggcagcgtggaggccttcccccagtccaacgccgtcatccaggacgaggagcgcgacatccccgagcggagctggaactccggctacgactggatcaccgacttccccgggaagaccgtgtggttcgtgcccagcatcaagtccggcaacgacatcgccaactgcctgcgcaagaacgggaagcgggtcatccagctgagccgcaagacgttcgacaccgagtaccagaagaccaagaacaacgactgggactacgtggtgaccacggacatctccgagatgggcgcgaacttccgggccgaccgcgtcatcgacccccggcgctgcctcaagcccgtgatcctgaaggacgggcccgagcgggtcatcctggccggcccgatgcccgtgaccgtggccagcgcggcccagcgccggggccgcatcgggcgcaaccagaacaaggagggcgaccagtacgtctacatggggcagcccctcaacaacgacgaggaccacgcccactggaccgaggccaagatgctgctggacaacatcaacacccccgagggcatcatcccggccctcttcgagcccgagcgggagaagtccgcggccatcgacggggagtaccgcctgcggggcgaggcccgcaagacgttcgtggagctgatgcggcgcggcgacctccccgtgtggctgagctacaaggtcgcctccgaggggttccagtacagcgaccggcgctggtgcttcgacggcgagcggaacaaccaggtgctggaggagaacatggacgtggagatctggaccaaggagggggagcgcaagaagctccggccccgctggctggacgcccggacctactccgacccgctggcgctccgcgagttcaaggagttcgccgccggccggcgcagcgtcagcggcgacctgatcctggagatcgggaagctcccccagcacctgaccctgcgggcccagaacgccctcgacaacctggtgatgctgcacaactccgagcagggcgggaaggcgtaccgccacgccatggaggagctccccgacaccatcgagacgctgatgctgctcgccctgatcgccgtgctgaccggcggggtcaccctcttcttcctgagcggcaagggcctggggaagacctccatcggcctcctgtgcgtgacggcgagctccgccctgctctggatggccagcgtggagccccactggatcgccgcctccatcatcctggagttcttcctgatggtcctcctgatcccggagcccgaccggcagcgcacgccccaggacaaccagctggcgtacgtggtgatcgggctcctgttcatgatcctgaccgtcgccgccaacgagatgggcctcctggagaccacgaagaaggacctggggatcggctacgtggccgccgagaaccaccagcacgcgaccatgctcgacgtggacctgcacccggccagcgcctggaccctgtacgccgtcgccaccacggtgatcacccccatgatgcggcacaccatcgagaacaccacggcgaacatctccctcaccgccatcgccaaccaggccgccatcctgatgggcctggacaaggggtggcccatcagcaagatggacatcggcgtgcccctcctggcgctggggtgctactcccaggtcaacccgctcaccctgaccgccgccgtgctgatgctcgtggcccactacgcgatcatcggccccgggctgcaggccaaggccacgcgcgaggcccagaagcgcaccgccgcgggcatcatgaagaaccccaccgtcgacggcatcgtggccatcgacctggaccccgtggtctacgacgccaagttcgagaagcagctcgggcagatcatgctgctgatcctctgcaccagccagatcctgctgatgcggacgacctgggccctctgcgagtccatcaccctggccaccggcccgctgacgaccctctgggaggggagccccggcaagttctggaacaccaccatcgcggtgtccatggccaacatcttccgcggcagctacctggccggggccggcctggccttctccctcatgaagtccctcgggggcgggcggcgcgggacgggcgcgcagggggagaccctgggcgagaagtggaagcggcagctcaaccagctgtccaagagcgagttcaacacctacaagcgcagcgggatcatggaggtggaccggtccgaggccaaggagggcctgaagcgcggggagaccacgaagcacgccgtcagccggggcaccgccaagctccgctggttcgtggagcggaacctggtgaagcccgagggcaaggtcatcgacctggggtgcggccgcgggggctggtcctactactgcgcggggctgaagaaggtgaccgaggtgaagggctacaccaagggcgggcccggccacgaggagccgatccccatggccacctacgggtggaacctcgtcaagctgcacagcggcaaggacgtgttcttcatgccgcccgagaagtgcgacacgctgctctgcgacatcggggagtccagcccgaaccccaccatcgaggagggccggaccctgcgcgtgctgaagatggtcgagccctggctccggggcaaccagttctgcatcaagatcctgaacccctacatgccgtccgtggtggagaccctggagcagatgcagcgcaagcacgggggcatgctcgtccggaaccccctgagccgcaactccacgcacgagatgtactgggtgagctgcgggaccggcaacatcgtgtccgccgtcaacatgaccagccggatgctgctcaaccgcttcaccatggcccaccgcaagcccacgtacgagcgggacgtggacctgggcgccgggacccgccacgtggcggtcgagcccgaggtggccaacctggacatcatcggccagcggatcgagaacatcaagaacgagcacaagtccacctggcactacgacgaggacaacccgtacaagacctgggcctaccacgggagctacgaggtcaagccctccggcagcgcctccagcatggtgaacggggtggtccgcctcctgacgaagccctgggacgtgatccccatggtgacccagatcgccatgaccgacaccacgccgttcggccagcagcgggtcttcaaggagaaggtggacacccgcacgccccgggcgaagcgcggcaccacgcagatcatggaggtgaccgccaagtggctgtgggggttcctctcccggaacaagaagccccgcatctgcacccgggaggagttcacccgcaaggtccggagcaacgccgccatcggcgccgtgttcgtggacgagaaccagtggaacagcgcgaaggaggccgtcgaggacgagcgcttctgggacctggtgcaccgggagcgcgagctgcacaagcaggggaagtgcgccacgtgcgtgtacaacatgatgggcaagcgggagaagaagctcggggagttcggcaaggccaagggctcccgcgcgatctggtacatgtggctgggggcccggttcctggagttcgaggccctcggcttcatgaacgaggaccactggttcagccgcgagaactccctgagcggggtcgagggcgaggggctgcacaagctcggctacatcctgcgggacatctccaagatcccgggcgggaacatgtacgccgacgacaccgccggctgggacacccgcatcaccgaggacgacctgcagaacgaggcgaagatcacggacatcatggagcccgagcacgccctcctggccaccagcatcttcaagctgacctaccagaacaaggtggtgcgcgtccagcggcccgccaagaacgggaccgtgatggacgtgatctcccgccgggaccagcgcggcagcggccaggtcgggacgtacggcctcaacaccttcaccaacatggaggtgcagctgatccggcagatggagtccgaggggatcttcctgcccagcgagctcgagaccccgaacctggccgagcgcgcgctggactggctcgagaagcacggcgccgagcggctgaagcgcatggccatctccggggacgactgcgtggtcaagcccatcgacgaccggttcgccacggccctgaccgcgctcaacgacatgggcaaggtgcgcaaggacatcccccagtgggagcccagcaagggctggaacgactggcagcaggtcccgttctgctcccaccacttccaccagctgatcatgaaggacgggcgggagatcgtcgtgccctgccgcaaccaggacgagctggtgggccgggcccgcgtcagccagggggccggctggtccctccgggagaccgcctgcctgggcaagagctacgcccagatgtggcagctgatgtacttccaccgccgggacctccgcctggcggccaacgccatctgctccgccgtgcccgtggactgggtccccaccagccggaccacgtggagcatccacgcgcaccaccagtggatgaccaccgaggacatgctgtccgtgtggaaccgcgtgtggatcgaggagaacccgtggatggaggacaagacccacgtcagctcctgggaggaggtgccctacctcggcaagcgcgaggaccagtggtgcggcagcctgatcgggctgacggcccgggccacctgggccaccaacatccaggtggccatcaaccaggtccgccggctcatcggcaacgagaactacctggactacatgacctccatgaagcgcttcaagaacgagagcgaccccgagggggcgctgtggtga

SEQ ID NO: 8261 - RNA, 9879 nt, synthetic construct
  misc_feature 1..9879: note = derived and/or modified CDS sequence (opt1) from DENV-1__FJ850103__SS-prME
  source 1..9879: mol_type = other RNA
agcgtgaccatgctgctcatgctgctgcccaccgccctcgccttccacctgacgacccgcggcggggagccgcacatgatcgtctccaagcaggagcggggcaagagcctgctcttcaagacctccgcgggggtgaacatgtgcaccctgatcgccatggacctgggcgagctctgcgaggacacgatgacctacaagtgcccccgcatcaccgaggccgagcccgacgacgtggactgctggtgcaacgccaccgacacgtgggtcacctacgggacctgcagccagaccggcgagcaccggcgcgagaagcggtccgtggccctggcgccccacgtgggcctggggctcgagacgcgcaccgagacctggatgagctccgagggcgcctggaagcagatccagcgggtcgagacctgggccctgcgccacccggggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcaccccccaggcccccacgagcgagatccagctgaccgactacggggccctgaccctcgactgctccccccgcaccggcctggacttcaacgagatggtcctgctcacgatgaaggagaagagctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccccccttcggggagagctacatcgtggtcggcgccggcgagaaggcgctcaagctgtcctggttcaagcgcgggagctccatcggcaagatgttcgaggccaccgcccggggggcccgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagagctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtcaagacctgcatctggcccaagagccacacgctgtggtccaacggggtgctcgagagcgagatgatcatccccaagatctacggcgggccgatctcccagcacaactaccggcccggctacttcacccagaccgccgggccctggcacctgggcaagctggagctcgacttcgacctgtgcgagggcaccacggtggtcgtggacgagcactgcgggaaccgcggcccgagcctgcggaccaccaccgtgacggggaagatcatccacgagtggtgctgccgctcctgcaccctcccccccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgtgagcatcatgatcgaggaggtgatgcggtcccgctggagccgcaagatgctgatgaccgggaccctcgccgtcttcctgctgctcatcatgggccagctgacgtggaacgacctgatccggctctgcatcatggtgggggccaacgcgtccgaccgcatgggcatgggcaccacctacctggccctgatggccaccttcaagatgcggccgatgttcgccgtggggctcctgttccgccggctgacgagccgcgaggtcctcctgctgaccatcggcctctccctggtggccagcgtcgagctgcccaactccctcgaggagctgggggacggcctggcgatgggcatcatgatgctcaagctgctgaccgagttccagccccaccagctctggaccacgctgctgagcctcaccttcgtgaagaccaccctgtccctggactacgcctggaagacgaccgccatggtgctcagcatcgtctccctgttccccctgtgcctcagcaccacctcccagaagacgacctggctgccggtgctgctcgggagcttcggctgcaagcccctgaccatgttcctgatcaccgagaacaagatctgggggcggaagtcctggcccctcaacgagggcatcatggccatcgggatcgtgagcatcctgctgtccagcctcctgaagaacgacgtccccctggcgggcccgctcatcgccggcgggatgctgatcgcctgctacgtgatcagcggctccagcgccgacctgtccctcgagaaggccgcggaggtgagctgggagcaggaggccgagcactccggggccagccacaacatcctggtcgaggtgcaggacgacggcaccatgaagatcaaggacgaggagcgcgacgacacgctgaccatcctcctgaaggccaccctgctcgccgtgtccggggtctaccccatgagcatccccgcgaccctgttcgtgtggtacttctggcagaagaagaagcagcggtccggcgtgctgtgggacacgcccagcccgcccgaggtcgagcgcgccgtgctcgacgacggcatctaccggatcctgcagcgcgggctgctgggccggtcccaggtgggggtcggcgtgttccaggacggggtgttccacaccatgtggcacgtcacccgcggcgccgtgctcatgtaccagggcaagcggctggagcccagctgggcctccgtgaagaaggacctgatcagctacgggggcgggtggcgcttccagggctcctggaacaccggggaggaggtccaggtgatcgccgtggagcccggcaagaacccgaagaacgtccagacgacccccggcaccttcaagacccccgagggggaggtgggcgcgatcgccctcgacttcaagcccgggacgagcggctccccgatcgtgaaccgggagggcaagatcgtcgggctgtacggcaacggggtggtgaccaccagcggcacctacgtctccgccatcgcccaggccaaggcgagccaggaggggcccctgcccgagatcgaggacgaggtgttcaagaagcgcaacctcacgatcatggacctgcacccgggcagcggcaagacccggcgctacctgcccgccatcgtgcgggagtccatcaagcgcaagctccgcaccctgatcctggcccccacccgggtcgtggccagcgagatggcggaggccctcaaggggatgcccatccgctaccagacgaccgccgtgaagtccgagcacaccggccgggagatcgtcgacctgatgtgccacgccaccttcacgatgcgcctgctcagcccggtgcgggtgcccaactacaacatgatcatcatggacgaggcccacttcaccgaccccgcgtccatcgccgcccgcgggtacatcagcacccgggtcggcatgggggaggccgccgcgatcttcatgaccgccacgcccccgggctccgtggaggccttcccccagagcaacgccgtgatccaggacgaggagcgcgacatccccgagcggtcctggaacagcggctacgactggatcaccgacttccccgggaagaccgtctggttcgtgccgtccatcaagagcggcaacgacatcgccaactgcctgcgcaagaacgggaagcgggtgatccagctgtcccgcaagaccttcgacacggagtaccagaagaccaagaacaacgactgggactacgtcgtgaccaccgacatcagcgagatgggcgcgaacttccgggccgaccgcgtgatcgacccccggcgctgcctcaagcccgtcatcctgaaggacgggcccgagcgggtgatcctggccggcccgatgcccgtcacggtggcctccgcggcccagcgccggggccgcatcgggcgcaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgggagaagagcgcggccatcgacggggagtaccgcctgcggggcgaggcccgcaagaccttcgtcgagctgatgcggcgcggcgacctccccgtgtggctgtcctacaaggtggccagcgaggggttccagtactccgaccggcgctggtgcttcgacggcgagcggaacaaccaggtcctggaggagaacatggacgtggagatctggacgaaggagggggagcgcaagaagctccggccccgctggctggacgcccggacctacagcgacccgctggcgctccgcgagttcaaggagttcgccgccggccggcgcagcgtgtccggcgacctgatcctggagatcgggaagctcccccagcacctgaccctgcgggcccagaacgccctcgacaacctggtcatgctgcacaacagcgagcagggcgggaaggcgtaccgccacgccatggaggagctccccgacaccatcgagaccctgatgctgctcgccctgatcgccgtgctgacgggcggggtgaccctcttcttcctgtccggcaagggcctggggaagaccagcatcggcctcctgtgcgtcaccgcgtccagcgccctgctctggatggcctccgtggagccccactggatcgccgccagcatcatcctggagttcttcctgatggtgctcctgatcccggagcccgaccggcagcgcacgccccaggacaaccagctggcgtacgtcgtgatcgggctcctgttcatgatcctgaccgtggccgccaacgagatgggcctcctggagaccaccaagaaggacctggggatcggctacgtcgccgccgagaaccaccagcacgcgacgatgctcgacgtggacctgcacccggcctccgcctggaccctgtacgccgtggccaccaccgtcatcacgcccatgatgcggcacaccatcgagaacaccaccgcgaacatcagcctcacggccatcgccaaccaggccgccatcctgatgggcctggacaaggggtggcccatctccaagatggacatcggcgtgcccctcctggcgctggggtgctacagccaggtgaacccgctcaccctgaccgccgccgtcctgatgctcgtggcccactacgcgatcatcggccccgggctgcaggccaaggccacccgcgaggcccagaagcgcacggccgcgggcatcatgaagaaccccaccgtggacggcatcgtcgccatcgacctggaccccgtggtgtacgacgccaagttcgagaagcagctcgggcagatcatgctgctgatcctctgcacctcccagatcctgctgatgcggaccacgtgggccctctgcgagagcatcaccctggccaccggcccgctgaccacgctctgggaggggtcccccggcaagttctggaacaccaccatcgcggtcagcatggccaacatcttccgcggctcctacctggccggggccggcctggccttcagcctcatgaagtccctggggggcgggcggcgcggcaccggcgcgcagggggagacgctgggcgagaagtggaagcggcagctcaaccagctgagcaagagcgagttcaacacctacaagcgctccgggatcatggaggtggaccggagcgaggccaaggagggcctgaagcgcggggagaccaccaagcacgccgtgtcccggggcacggccaagctccgctggttcgtcgagcggaacctggtgaagcccgagggcaaggtgatcgacctggggtgcggccgcgggggctggagctactactgcgcggggctgaagaaggtcaccgaggtgaagggctacaccaagggcgggcccggccacgaggagccgatccccatggccacctacgggtggaacctcgtgaagctgcactccggcaaggacgtcttcttcatgccccccgagaagtgcgacaccctgctctgcgacatcggggagagctccccgaaccccacgatcgaggagggccggaccctgcgcgtgctgaagatggtggagccctggctccggggcaaccagttctgcatcaagatcctgaacccctacatgccgagcgtcgtggagaccctggagcagatgcagcgcaagcacgggggcatgctcgtgcggaaccccctgtcccgcaacagcacccacgagatgtactgggtctcctgcgggacgggcaacatcgtgagcgccgtgaacatgacctcccggatgctgctcaaccgcttcaccatggcccaccgcaagcccacctacgagcgggacgtcgacctgggcgccgggacgcgccacgtggcggtggagcccgaggtcgccaacctggacatcatcggccagcggatcgagaacatcaagaacgagcacaagagcacctggcactacgacgaggacaacccgtacaagacctgggcctaccacgggtcctacgaggtgaagcccagcggctccgccagctccatggtcaacggggtggtgaagctcctgaccaagccctgggacgtcatccccatggtgacgcagatcgccatgaccgacaccaccccgttcggccagcagcgcgtgttcaaggagaaggtcgacacgcggaccccccgcgcgaagcggggcaccacccagatcatggaggtgacggccaagtggctgtgggggttcctcagccgcaacaagaagccccggatctgcacccgcgaggagttcacccggaaggtgcgcagcaacgccgccatcggcgccgtcttcgtggacgagaaccagtggaactccgcgaaggaggccgtggaggacgagcggttctgggacctggtccaccgcgagcgggagctgcacaagcaggggaagtgcgccacctgcgtgtacaacatgatgggcaagcgcgagaagaagctcggggagttcggcaaggccaagggcagccgggcgatctggtacatgtggctgggggcccgcttcctggagttcgaggccctcggcttcatgaacgaggaccactggttctcccgggagaacagcctgtccggggtggagggcgaggggctgcacaagctcggctacatcctgcgcgacatcagcaagatcccgggcgggaacatgtacgccgacgacacggccggctgggacacccggatcaccgaggacgacctgcagaacgaggcgaagatcaccgacatcatggagcccgagcacgccctcctggccacgtccatcttcaagctgacctaccagaacaaggtcgtgcgcgtgcagcgccccgccaagaacgggaccgtcatggacgtgatcagccggcgcgaccagcggggctccggccaggtggggacctacggcctcaacacgttcaccaacatggaggtccagctgatccgccagatggagagcgaggggatcttcctgccctccgagctcgagaccccgaacctggccgagcgggcgctggactggctcgagaagcacggcgccgagcgcctgaagcggatggccatcagcggggacgactgcgtggtgaagcccatcgacgaccgcttcgccaccgccctgacggcgctcaacgacatgggcaaggtccggaaggacatcccccagtgggagccctccaagggctggaacgactggcagcaggtgccgttctgcagccaccacttccaccagctgatcatgaaggacgggcgcgagatcgtggtcccctgccggaaccaggacgagctggtgggccgcgcccgggtgtcccagggggccggctggagcctccgcgagaccgcctgcctggggaagtcctacgcccagatgtggcagctgatgtacttccaccggcgcgacctccggctggcggccaacgccatctgcagcgccgtccccgtggactgggtgcccaccagccgcaccacctggtccatccacgcgcaccaccagtggatgacgaccgaggacatgctgagcgtctggaaccgggtgtggatcgaggagaacccgtggatggaggacaagacccacgtgtccagctgggaggaggtcccctacctcggcaagcgcgaggaccagtggtgcggctccctgatcgggctgaccgcccgcgccacgtgggccaccaacatccaggtggccatcaaccaggtgcggcgcctcatcggcaacgagaactacctggactacatgaccagcatgaagcggttcaagaacgagtccgaccccgagggggcgctgtggtga

SEQ ID NO: 8262 - RNA, 9879 nt, synthetic construct
  misc_feature 1..9879: note = derived and/or modified CDS sequence (opt1) from DENV-1__FJ850104__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgtgaccgacacctgggtgacctacgggacctgcagccagaccggcgagcaccggcgcgacaagcggtccgtggccctggcgccccacgtcggcctggggctcgagacccgcaccgagacctggatgagctccgagggcgcgtggaagcagatccagcgggtggagacctgggccctgcgccaccccgggttcacggtgatcgccctgttcctcgcccacgcgatcggcaccagcatcacccagaaggggatcatcttcatcctgctgatgctcgtgaccccctccatggccatgcggtgcgtgggcatcggcaaccgcgacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccggaagctgtgcatcgaggcgaagatcagcaacaccaccacggactcccgctgcccgacccagggcgaggccaccctggtcgaggagcaggacgccaacttcgtgtgccggcgcaccttcgtggaccggggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccgcaccggcctggacttcaacgagatggtgctcctgacgatgaaggagaagtcctggctggtgcacaagcagtggttcctcgacctgccgctgccctggacctccggggccagcaccagccaggagacctggaaccggcaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccgcctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttctccacccaggacgagaagggggtcacccagaacggccggctcatcacggccaacccgatcgtgaccgacaaggagaagcccgtgaacatcgagaccgagccgcccttcggggagagctacatcgtcgtgggcgccggcgagaaggccctgaagctgtcctggttcaagaaggggagctccatcggcaagatgttcgaggcgaccgcccgcggggcccggcgcatggccatcctcggcgacacggcctgggacttcgggagcatcggcggcgtgttcacctccgtcgggaagctggtgcaccaggtgttcggcaccgcgtacggggtcctgttcagcggcgtgtcctggaccatgaagatcgggatcggcatcctcctgacgtggctgggcctcaacagccgctccaccagcctgtccatgacctgcatcgccgtggggatggtcaccctgtacctcggcgtgatggtgcaggccgacagcgggtgcgtcatcaactggaagggccgggagctgaagtgcgggtccggcatcttcgtgacgaacgaggtgcacacctggaccgagcagtacaagttccaggccgacagcccgaagcgcctgagcgccgcgatcggcaaggcctgggaggagggggtctgcggcatccggtccgccacccgcctcgagaacatcatgtggaagcagatcagcaacgagctgaaccacatcctgctcgagaacgacatgaagttcaccgtggtggtcggggacgccaacggcatcctggcccaggggaagaagatgatccggccccagcccatggagcacaagtactcctggaagtcctggggcaaggcgaagatcatcggcgccgacatccagaacacgaccttcatcatcgacgggcccgacaccccggagtgccccgacggccagcgcgcctggaacatctgggaggtggaggactacgggttcggcatcttcaccacgaacatctggctgaagctccgggactcctacacccagatgtgcgaccaccgcctgatgagcgccgcgatcaaggactccaaggccgtgcacgccgacatgggctactggatcgagagcgagaagaacgagacctggaagctggcccgggcctccttcatcgaggtcaagacctgcacgtggcccaagagccacaccctctggtccaacggggtgctggagagcgagatgatcatccccaagatctacggcgggccgatctcccagcacaaccaccgccccggctacttcacccagaccgcggggccctggcacctgggcaagctcgagctggacttcgacctgtgcgagggcacgaccgtggtcgtggacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtcaaggagaaggaggagaacctcgtgcggagcatggtgtccgccggcagcggggaggtcgacagcttctccctgggcatcctgtgcgtgagcatcatgatcgaggaggtgatgcgctcccggtggagccgcaagatgctcatgaccgggacgctggccgtcttcctgctcctgatcatgggccagctgacctggaacgacctcatccgcctgtgcatcatggtgggggccaacgcctccgaccggatgggcatgggcaccacctacctggccctcatggccacgttcaagatgcgcccgatgttcgccgtggggctgctgttccggcgcctcaccagccgggaggtcctgctgctcaccatcgggctgtccctggtggccagcgtcgagctccccaactccctggaggagctgggggacggcctcgccatgggcatcatgatgctgaagctgctcaccgagttccagccccaccagctgtggacgaccctgctcagcctgaccttcgtgaagaccacgctgtccctcgactacgcgtggaagaccaccgccatggtgctgagcatcgtctccctgttccccctctgcctgagcaccacgtcccagaagaccacctggctgccggtgctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtccccctcgccggcccgctgatcgcgggcgggatgctgatcgcctgctacgtgatcagcggctccagcgccgacctctccctggagaaggccgccgaggtgagctgggagcaggaggcggagcactccggggccagccacaacatcctggtcgaggtgcaggacgacggcacgatgaagatcaaggacgaggagcgggacgacaccctcaccatcctgctgaaggccaccctcctggccgtgtccggggtctaccccatgagcatccccgccacgctgttcgtgtggtacttctggcagaagaagaagcagcgctccggcgtgctctgggacacccccagcccgcccgaggtcgagcgggcggtgctggacgacggcatctaccgcatcctgcagcgggggctgctcggccgctcccaggtgggggtcggcgtgttccaggacggggtgttccacaccatgtggcacgtcacccggggcgccgtgctgatgtaccagggcaagcgcctggagcccagctgggcctccgtgaagaaggacctcatcagctacgggggcgggtggcggttccagggctcctggaacacgggggaggaggtccaggtgatcgccgtggagcccggcaagaacccgaagaacgtccagaccacccccggcaccttcaagacgcccgagggggaggtgggcgccatcgcgctggacttcaagcccgggaccagcggctccccgatcgtgaaccgcgagggcaagatcgtcgggctgtacggcaacggggtggtgaccaccagcggcacgtacgtctccgccatcgcccaggccaaggccagccaggaggggcccctccccgagatcgaggacgaggtgttcaagaagcggaacctgaccatcatggacctgcacccgggcagcggcaagacccgccggtacctccccgcgatcgtgcgcgaggccatcaagcggaagctgcgcaccctgatcctcgcccccacgcgcgtcgtggcctccgagatggcggaggccctgaaggggatgcccatccggtaccagaccaccgccgtcaagagcgagcacaccggccgcgagatcgtcgacctgatgtgccacgccacgttcaccatgcggctcctgtccccggtgcgcgtgcccaactacaacatgatcatcatggacgaggcccacttcaccgaccccgcgagcatcgccgcccgggggtacatctccacccgcgtcggcatgggggaggccgccgcgatcttcatgacggccacgccgcccggcagcgtggaggccttcccccagtccaacgccgtgatccaggacgaggagcgggacatccccgagcgcagctggaactccggctacgactggatcaccgacttccccgggaagaccgtctggttcgtgcccagcatcaagtccggcaacgacatcgccaactgcctgcggaagaacgggaagcgcgtgatccagctcagccggaagacgttcgacaccgagtaccagaagaccaagaacaacgactgggactacgtcgtgaccacggacatctccgagatgggcgcgaacttccgcgccgaccgggtgatcgacccccgccggtgcctgaagcccgtcatcctgaaggacgggcccgagcgcgtgatcctcgccggcccgatgcccgtcaccgtggccagcgcggcccagcggcgcggccggatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggccctgttcgagcccgagcgcgagaagtccgcggccatcgacggggagtaccggctgcgcggcgaggcccggaagacgttcgtcgagctcatgcgccggggcgacctgcccgtgtggctgagctacaaggtggcctccgaggggttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgacccgctcgcgctgcgggagttcaaggagttcgccgccggccgccggagcgtgagcggcgacctgatcctcgagatcgggaagctgccccagcacctgaccctccgcgcccagaacgccctggacaacctggtcatgctccacaactccgagcagggcgggaaggcgtaccggcacgccatggaggagctgcccgacaccatcgagacgctgatgctcctggccctgatcgccgtgctcaccggcggggtgaccctgttcttcctgagcggcaagggcctcgggaagacctccatcggcctgctgtgcgtcacggcgagctccgccctcctgtggatggccagcgtggagccccactggatcgccgcctccatcatcctggagttcttcctcatggtgctgctgatcccggagcccgaccgccagcggacgccccaggacaaccagctcgcgtacgtcgtgatcgggctgctgttcatgatcctcaccgtggccgccaacgagatgggcctgctggagaccacgaagaaggacctcgggatcggctacgtcgccgccgagaaccaccagcacgcgaccatgctggacgtggacctgcgcccggccagcgcctggaccctctacgccgtggccaccacggtcatcacccccatgatgcggcacaccatcgagaacaccacggcgaacatctccctgaccgccatcgccaaccaggccgccatcctgatgggcctcgacaaggggtggcccatcagcaagatggacatcggcgtgcccctgctggcgctcgggtgctactcccaggtgaacccgctgaccctgaccgccgccgtcctcatgctggtggcccactacgcgatcatcggccccgggctgcaggccaaggccacgcgcgaggcccagaagcgcaccgccgcgggcatcatgaagaaccccaccgtggacggcatcgtcgccatcgacctcgaccccgtggtgtacgacgccaagttcgagaagcagctggggcagatcatgctgctcatcctgtgcaccagccagatcctgctcatgcggacgacctgggccctgtgcgagtccatcaccctggccaccggcccgctcacgaccctgtgggaggggagccccggcaagttctggaacaccaccatcgcggtctccatggccaacatcttccgcggcagctacctggccggggccggcctcgccttctccctgatgaagtccctcgggggcgggcggcgcgggacgggcgcgcagggggagaccctcggcgagaagtggaagcggcagctgaaccagctgtccaagagcgagttcaacacctacaagcgcagcgggatcatggaggtggaccggtccgaggccaaggagggcctcaagcgcggggagaccacgaagcacgccgtgagccggggcaccgccaagctgcgctggttcgtcgagcggaacctggtgaagcccgagggcaaggtgatcgacctggggtgcggccgcgggggctggtcctactactgcgcggggctcaagaaggtcaccgaggtgaagggctacaccaagggcgggcccggccacgaggagccgatccccatggccacctacgggtggaacctggtgaagctgcacagcggcaaggacgtcttcttcatgccgcccgagaagtgcgacacgctcctgtgcgacatcggggagtccagcccgaaccccaccatcgaggagggccggaccctgcgcgtgctcaagatggtggagccctggctgcggggcaaccagttctgcatcaagatcctgaacccctacatgccgtccgtcgtggagaccctcgagcagatgcagcgcaagcacgggggcatgctggtgcggaaccccctgagccgcaactccacgcacgagatgtactgggtcagctgcgggaccggcaacatcgtgtccgccgtgaacatgaccagccggatgctcctgaaccgcttcaccatggcccaccgcaagcccacgtacgagcgggacgtcgacctgggcgccgggacccgccacgtggcggtggagcccgaggaggccaacctcgacatcatcggccagcggatcgagaacatcaagaacgagcacaagtccacctggcactacgacgaggacaacccgtacaagacctgggcctaccacgggagctacgaggtcaagccctccggcagcgcctccagcatggtgaacggggtcgtgcgcctgctgacgaagccctgggacgtgatccccatggtcacccagatcgccatgaccgacaccacgccgttcggccagcagcgggtgttcaaggagaaggtggacacccgcacgccccgggcgaagcgcggcaccacgcagatcatggaggtcaccgccaagtggctctgggggttcctgtcccggaacaagaagccccgcatctgcacccgggaggagttcacccgcaaggtgcggagcaacgccgccatcggcgccgtgttcgtcgacgagaaccagtggaacagcgcgaaggaggccgtggaggacgagcgcttctgggacctggtgcaccgggagcgcgagctccacaagcaggggaagtgcgccacgtgcgtctacaacatgatgggcaagcgggagaagaagctgggggagttcggcaaggccaagggctcccgcgcgatctggtacatgtggctgggggcccggttcctcgagttcgaggccctgggcttcatgaacgaggaccactggttcagccgcgagaactccctgagcggggtggagggcgaggggctccacaagctgggctacatcctgcgggacatctccaagatcccgggcgggaacatgtacgccgacgacaccgccggctgggacacccgcatcaccgaggacgacctccagaacgaggcgaagatcacggacatcatggagcccgagcacgccctgctggccaccagcatcttcaagctcacctaccagaacaaggtggtccgcgtgcagcggcccgccaagaacgggaccgtgatggacgtcatctcccgccgggaccagcgcggcagcggccaggtggggacgtacggcctgaacaccttcaccaacatggaggtgcagctgatccggcagatggagtccgaggggatcttcctccccagcgagctggagaccccgaacctggccgagcgcgtcctcgactggctggagaagcacggcgcggagcggctgaagcgcatggccatctccggggacgactgcgtggtgaagcccatcgacgaccggttcgccacggccctcaccgccctgaacgacatgggcaaggtccgcaaggacatcccccagtgggagcccagcaagggctggaacgactggcagcaggtcccgttctgctcccaccacttccaccagctgatcatgaaggacgggcgggagatcgtggtcccctgccgcaaccaggacgagctcgtgggccgggcgcgcgtgagccagggggccggctggtccctgcgggagaccgcctgcctgggcaagagctacgcccagatgtggcagctcatgtacttccaccgccgggacctgcgcctggccgcgaacgccatctgctccgccgtccccgtggactgggtgcccaccagccggaccacgtggagcatccacgcccaccaccagtggatgaccaccgaggacatgctctccgtctggaaccgcgtgtggatcgaggagaacccgtggatggaggacaagacccacgtgagctcctgggaggaggtcccctacctgggcaagcgcgaggaccagtggtgcggcagcctgatcgggctcacggcgcgggccacctgggccaccaacatccaggtggccatcaaccaggtgcgccggctgatcggcaacgagaactacctggactacatgacctccatgaagcgcttcaagaacgagagcgaccccgagggggccctctggtga

SEQ ID NO: 8263 - RNA, 9879 nt, synthetic construct
  misc_feature 1..9879: note = derived and/or modified CDS sequence (opt1) from DENV-1__JN819405__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacccacctggccctcatggccacgttcaagatgcgcccgatgttcgccgtggggctgctgttccggcgcctcaccagccgggaggtgctgctgctcaccatcggcctgtccctgatggccagcatggagctccccaactccctggaggagctgggggacggcctcgcgatgggcatcatgatgctgaagctgctcaccgagttccagccccaccagctgtggacgaccctgctcagcctgaccttcgtcaagaccacgctgtccctcgactacgcctggaagaccaccgccatgatcctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcacgatgaagatcaaggacgaggagcgggacgacaccctcaccatcctgctgaaggccaccctcctggccgtgtccggggtgtaccccatgagcatccccgcgacgctgttcgtctggtacttctggcagaagaagaagcagcgctccggcgtgctctgggacacccccagcccgcccgaggtggagcgggccgtcctggacgacggcatctaccgcatcctgcagcgggggctgctcggccgctcccaggtgggggtgggcgtcttccaggacggggtgttccacaccatgtggcacgtgacccggggcgccgtcctgatgtaccagggcaagcgcctggagcccagctgggcctccgtgaagaaggacctcatcagctacgggggcgggtggcggttccagggctcctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggaccagcggctccccgatcgtgaaccgcgagggcaagatcgtggggctgtacggcaacggggtcgtgaccaccagcggcacgtacgtgtccgccatcgcccaggccaaggcgagccaggaggggcccctccccgagatcgaggacgaggtcttcaagaagcggaacctgaccatcatggacctgcacccgggcagcggcaagacccgccggtacctccccgccatcgtgcgcgaggccatcaagcggaagctgcgcaccctgatcctcgcccccacgcgcgtggtcgcgtccgagatggccgaggccctgaaggggatgcccatccggtaccagaccaccgccgtcaagagcgagaccacgggccgcgagatcgtggacctgatgtgccacgccaccttcaccatgcggctcctgtccccggtccgcgtgcccaactacaacatgatcatcatggacgaggcgcacttcaccgaccccgccagcatcgccgcccgggggtacatctccacgcgcgtgggcatgggggaggccgcggccatcttcatgaccgccacgccgcccggcagcgtcgaggccttcccccagtccaacgccgtgatccaggacgaggagcgggacatccccgagcgcagctggaactccggctacgactggatcaccgacttccccgggaagacggtgtggttcgtccccagcatcaagtccggcaacgacatcgcgaactgcctgcggaagaacgggaagcgcgtgatccagctcagccggaagaccttcgacaccgagtaccagaagaccaagaacaacgactgggactacgtggtcacgaccgacatctccgagatgggcgccaacttccgcgccgaccgggtgatcgacccccgccggtgcctgaagcccgtgatcctgaaggacgggcccgagcgcgtcatcctcgccggcccgatgcccgtgaccgtggcgagcgccgcccagcggcgcggccggatcgggcgcaaccagaacaaggagggcgaccagtacgtctacatggggcagcccctgaacaacgacgaggaccacgcccactggaccgaggccaagatgctgctcgacaacatcaacacgcccgagggcatcatcccggcgctgttcgagcccgagcgcgagaagtccgccgccatcgacggggagtaccggctgcgcggcgaggcccggaagaccttcgtggagctcatgcgccggggcgacctgcccgtctggctgagctacaaggtggcctccgaggggttccagtacagcgaccgccggtggtgcttcgacggcgagcgcaacaaccaggtgctcgaggagaacatggacgtcgagatctggaccaaggagggggagcggaagaagctgcgcccccggtggctggacgcgcgcacctactccgacccgctcgccctgcgggagttcaaggagttcgccgccggccgccggagcgtgagcggcgacctgatcctcgagatcgggaagctgccccagcacctgaccctccgcgcccagaacgcgctggacaacctggtgatgctccacaactccgagcagggcgggaaggcctaccggcacgccatggaggagctgcccgacacgatcgagaccctgatgctcctggccctgatcgcggtcctcaccggcggggtgaccctgttcttcctgagcggcaagggcctcgggaagacgtccatcggcctgctgtgcgtgaccgccagctccgccctcctgtggatggccagcgtcgagccccactggatcgccgcgtccatcatcctggagttcttcctcatggtgctgctgatcccggagcccgaccgccagcggacgccccaggacaaccagctcgcctacgtggtcatcgggctgctgttcatgatcctcaccgtggccgccaacgagatgggcctgctggagacgaccaagaaggacctcgggatcggctacgtggccgcggagaaccaccagcacgccaccatgctggacgtcgacctgcgcccggccagcgcctggaccctctacgccgtggcgacgaccgtgatcacccccatgatgcggcacaccatcgagaacacgaccgccaacatctccctgaccgccatcgccaaccaggccgcgatcctgatgggcctcgacaaggggtggcccatcagcaagatggacatcggcgtccccctgctggccctcgggtgctactcccaggtgaacccgctgaccctgacggccgccgtgctcatgctggtcgcgcactacgccatcatcggccccgggctgcaggccaaggccacccgcgaggcccagaagcgcaccgcggccggcatcatgaagaaccccaccgtggacggcatcgtggccatcgacctcgaccccgtcgtgtacgacgccaagttcgagaagcagctggggcagatcatgctgctcatcctgtgcacgagccagatcctgctcatgcggaccacctgggccctgtgcgagtccatcaccctggcgacgggcccgctcaccaccctgtgggaggggagccccggcaagttctggaacaccacgatcgccgtgtccatggccaacatcttccgcggcagctacctggccggggccggcctcgcgttctccctgatgaagtccctcgggggcgggcggcgcgggaccggcgcccagggggagaccctcggcgagaagtggaagcggcagctgaaccagctgtccaagagcgagttcaacacctacaagcgcagcgggatcatggaggtcgaccggtccgaggccaaggagggcctcaagcgcggggagacgaccaagcacgccgtgagccggggcaccgcgaagctgcgctggttcgtggagcggaacctggtcaagcccgagggcaaggtgatcgacctggggtgcggccgcgggggctggtcctactactgcgccgggctcaagaacttcaccgaggtgaagggctacaccagcggcgggcccggccacgaggagccgatccccatggccacgtacgggtggaacctggtcaagctgcactccggcaaggacgtgttcttcatgccgcccgagaagtgcgacaccctcctgtgcgacatcggggagagctccccgaaccccaccatcgaggagggccggaccctgcgcgtgctcaagatggtcgagccctggctgaagggcaaccagttctgcatcaagatcctgaacccctacatgccgagcgtggtggagacgctcgagcagatgcagcggaagcacgggggcatgctggtccgcaaccccctgtcccggaacagcacccacgagatgtactgggtgtcctgcgggaccggcaacatcgtgagcgccgtcaacatgacctcccgcatgctcctgaaccggttcacgatggcccaccgcaagcccacctacgagcgcgacgtggacctgggcgcggggacccggcacgtggccgtcgagcccgaggtggccaacctcgacatcatcggccagcgcatcgagaacatcaagaacgagcacaagagcacctggcactacgacgaggacaacccgtacaagacgtgggcctaccacgggtcctacgaggtgaagcccagcggctccgccagctccatggtcaacggggtggtgcggctgctgaccaagccctgggacgtcatccccatggtgacccagatcgcgatgaccgacacgaccccgttcggccagcagcgcgtcttcaaggagaaggtggacacccggacgccccgcgccaagcggggcacgacccagatcatggaggtgaccgccaagtggctctgggggttcctgagccgcaacaagaagccccggatctgcacccgcgaggagttcacgcggaaggtccgcagcaacgccgccatcggcgcggtgttcgtggacgagaaccagtggaactccgccaaggaggccgtcgaggacgagcggttctgggacctggtgcaccgcgagcgggagctccacaagcaggggaagtgcgcgacctgcgtgtacaacatgatgggcaagcgcgagaagaagctgggggagttcggcaaggcgaagggcagccgggccatctggtacatgtggctgggggcccgcttcctcgagttcgaggccctgggcttcatgaacgaggaccactggttctcccgggagaacagcctgtccggggtcgagggcgaggggctccacaagctgggctacatcctgcgcgacatcagcaagatcccgggcgggaacatgtacgccgacgacaccgcgggctgggacacccggatcacggaggacgacctccagaacgaggccaagatcaccgacatcatggagcccgagcacgccctgctggccacctccatcttcaagctcacctaccagaacaaggtggtgcgcgtccagcgccccgccaagaacgggacggtgatggacgtgatcagccggcgcgaccagcggggctccggccaggtcgggacctacggcctgaacaccttcaccaacatggaggtgcagctgatccgccagatggagagcgaggggatcttcctcccctccgagctggagacgccgaacctggcggagcgggtgctcgactggctggagaagcacggcgccgagcgcctgaagcggatggccatcagcggggacgactgcgtcgtgaagcccatcgacgaccgcttcgccaccgccctcaccgcgctgaacgacatgggcaaggtgcggaaggacatcccccagtgggagccctccaagggctggaacgactggcagcaggtcccgttctgcagccaccacttccaccagctgatcatgaaggacgggcgcgagatcgtggtgccctgccggaaccaggacgagctcgtcggccgcgcccgggtgtcccagggggccggctggagcctgcgcgagaccgcctgcctggggaagtcctacgcccagatgtggcagctcatgtacttccaccggcgcgacctgcggctggcggccaacgccatctgcagcgccgtgcccgtcgactgggtgcccaccagccgcacgacctggtccatccacgcgcaccaccagtggatgaccaccgaggacatgctcagcgtgtggaaccgggtctggatcgaggagaacccgtggatggaggacaagacgcacgtgtccagctgggaggaggtgccctacctgggcaagcgcgaggaccagtggtgcggctccctgatcgggctcaccgcccgcgccacctgggccaccaacatccaggtcgccatcaaccaggtgcggcgcctgatcggcaacgagaactacctggactacatgacgagcatgaagcggttcaagaacgagtccgaccccgagggggcgctctggtga

SEQ ID NO: 8264 - RNA, 9879 nt, synthetic construct
  misc_feature 1..9879: note = derived and/or modified CDS sequence (opt1) from DENV-1__GQ199877__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcgcgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctgtggtccaacggggtgctcgagagcgagatgatcatccccaagatctacggcgggccgatctcccagcacaactaccggcccggctacttcacccagaccgccgggccctggcacctgggcaagctggagctcgacttcgacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgtgagcatcatgatcgaggaggtgatgcggtcccgctggagccgcaagatgctgatgaccgggacgctcgccgtcttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtggggctcctgttccgccggctgaccagccgcgaggtcctcctgctgaccatcggcctctccctggtggccagcgtcgagctgccctccagcctcgaggagctgggggacggcctggcgatgggcatcatgatgctcaagctgctgaccgagttccagccccaccagctctggacgaccctgctgtccctcaccttcgtgaagaccacgctgagcctggactacgcctggaagaccaccgccatggtgctctccatcgtcagcctgttccccctgtgcctctccaccacgagccagaagaccacctggctgccggtgctgctcgggtccttcggctgcaagcccctgaccatgttcctgatcaccgagaacaagatctgggggcgcaagagctggcccctcaacgagggcatcatggccatcgggatcgtgtccatcctgctgagcagcctcctgaagaacgacgtccccctggcgggcccgctcatcgccggcgggatgctgatcgcctgctacgtgatctccggcagctccgccgacctgagcctcgagaaggccgcggaggtgtcctgggagcaggaggccgagcacagcggggcctcccacaacatcctggtcgaggtgcaggacgacggcacgatgaagatcaaggacgaggagcgcgacgacaccctgaccatcctcctgaaggccaccctgctcgccgtgagcggggtctaccccatgtccatccccgcgacgctgttcgtgtggtacttctggcagaagaagaagcagcggagcggcgtgctgtgggacaccccctccccgcccgaggtcgagcgcgccgtgctcgacgacggcatctaccggatcctgcagcgcgggctgctgggccggagccaggtgggggtcggcgtgttccaggacggggtgttccacaccatgtggcacgtcacccgcggcgccgtgctcatgtaccagggcaagcggctggagccctcctgggccagcgtgaagaaggacctgatctcctacgggggcgggtggcgcttccagggcagctggaacacgggggaggaggtccaggtgatcgccgtggagcccggcaagaacccgaagaacgtccagaccacccccggcaccttcaagacgcccgagggggaggtgggcgcgatcgccctcgacttcaagcccgggacctccggcagcccgatcgtgaaccgggagggcaagatcgtcgggctgtacggcaacggggtggtgaccacctccggcacgtacgtcagcgccatcgcccaggccaaggcgagccaggaggggcccctgcccgagatcgaggacgaggtgttcaagaagcgcaacctcaccatcatggacctgcacccgggctccggcaagacccggcgctacctgcccgccatcgtgcgggaggccatcaagcgcaagctccgcaccctgatcctggcccccacgcgggtcgtggcgagcgagatggccgaggccctcaaggggatgcccatccgctaccagaccaccgccgtgaagtccgagcacaccggccgggagatcgtcgacctgatgtgccacgccacgttcaccatgcgcctgctcagcccggtgcgggtgcccaactacaacatgatcatcatggacgaggcgcacttcaccgaccccgcctccatcgccgcccgcgggtacatcagcacccgggtcggcatgggggaggccgcggccatcttcatgacggccacgccgcccggctccgtggaggccttcccccagagcaacgccgtgatccaggacgaggagcgcgacatccccgagcggtcctggaacagcggctacgactggatcaccgacttccccgggaagaccgtctggttcgtgccctccatcaagagcggcaacgacatcgcgaactgcctgcgcaagaacgggaagcgggtgatccagctgtcccgcaagacgttcgacaccgagtaccagaagaccaagaacaacgactgggactacgtcgtgaccacggacatcagcgagatgggcgccaacttccgggccgaccgcgtgatcgacccccggcgctgcctcaagcccgtcatcctgaaggacgggcccgagcgggtgatcctggccggcccgatgcccgtcaccgtggcgtccgccgcccagcgccggggccgcatcgggcgcaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgggagaagtccgccgccatcgacggggagtaccgcctgcggggcgaggcccgcaagacgttcgtcgagctgatgcggcgcggcgacctccccgtgtggctgtcctacaaggtggccagcgaggggttccagtactccgaccggcgctggtgcttcgacggcgagcggaacaaccaggtcctggaggagaacatggacgtggagatctggaccaaggagggggagcgcaagaagctccggccccgctggctggacgcgcggacctacagcgacccgctggccctccgcgagttcaaggagttcgccgccggccggcgcagcgtgtccggcgacctgatcctggagatcgggaagctcccccagcacctgaccctgcgggcccagaacgcgctcgacaacctggtcatgctgcacaacagcgagcagggcgggaaggcctaccgccacgccatggaggagctccccgacaccatcgagacgctgatgctgctcgccctgatcgcggtgctgaccggcggggtgaccctcttcttcctgtccggcaagggcctggggaagaccagcatcggcctcctgtgcgtcacggcctccagcgccctgctctggatggcctccgtggagccccactggatcgccgcgagcatcatcctggagttcttcctgatggtgctcctgatcccggagcccgaccggcagcgcacgccccaggacaaccagctggcctacgtcgtgatcgggctcctgttcatgatcctgaccgtggccgccaacgagatgggcctcctggagaccacgaagaaggacctggggatcggctacgtcgccgcggagaaccaccagcacgccaccatgctcgacgtggacctgcacccggcctccgcctggaccctgtacgccgtggcgaccacggtcatcacccccatgatgcggcacaccatcgagaacaccacggccaacatcagcctcaccgccatcgccaaccaggccgcgatcctgatgggcctggacaaggggtggcccatctccaagatggacatcggcgtgcccctcctggccctggggtgctacagccaggtgaacccgctcaccctgaccgccgccgtcctgatgctcgtggcgcactacgccatcatcggccccgggctgcaggccaaggccacgcgcgaggcccagaagcgcaccgcggccggcatcatgaagaaccccaccgtggacggcatcgtcgccatcgacctggaccccgtggtgtacgacgccaagttcgagaagcagctcgggcagatcatgctgctgatcctctgcacctcccagatcctgctgatgcggacgacctgggccctctgcgagagcatcaccctggcgaccggcccgctgacgaccctctgggaggggtcccccggcaagttctggaacaccaccatcgccgtcagcatggccaacatcttccgcggctcctacctggccggggccggcctggcgttcagcctcatgaagtccctcgggggcgggcggcgcggcacgggcgcccagggggagaccctgggcgagaagtggaagcggcagctcaaccagctgagcaagagcgagttcaacacctacaagaagtccgggatcatggaggtggaccgcagcgaggccaaggagggcctgaagcgcggggagaccacgaagcacgccgtgtcccgcggcaccgcgaagctccggtggttcgtcgagcgcaacctggtgaagcccgagggcaaggtgatcgacctggggtgcggccgcgggggctggagctactactgcgccgggctgaagaaggtcaccgaggtgaagggctacaccaagggcgggcccggccacgaggagccgatccccatggccacctacgggtggaacctcgtgaagctgcactccggcaaggacgtcttcttcatgccgcccgagaagtgcgacacgctgctctgcgacatcggggagagctccccgaaccccaccatcgaggagggccgcaccctgcgggtgctgaagatggtggagccctggctccgcggcaaccagttctgcatcaagatcctgaacccctacatgccgagcgtcgtggagaccctggagcagatgcagcggaagcacgggggcatgctcgtgcgcaaccccctgtcccggaacagcacgcacgagatgtactgggtctcctgcgggaccggcaacatcgtgagcgccgtgaacatgacctcccgcatgctgctcaaccggttcaccatggcccaccgcaagcccacgtacgagcgcgacgtcgacctgggcgcggggacccggcacgtggccgtggagcccgaggtcgccaacctggacatcatcggccagcgcatcgagaacatcaagaacgagcacaagagcacctggcactacgacgaggacaacccgtacaagacctgggcctaccacgggtcctacgaggtgaagcccagcggctccgccagctccatggtcaacggggtggtgcggctcctgacgaagccctgggacgtcatccccatggtgacccagatcgcgatgaccgacaccacgccgttcggccagcagcgcgtgttcaaggagaaggtcgacacccggacgccccgggccaagcggggcaccacgcagatcatggaggtgaccgccaagtggctgtgggggttcctcagccgcaacaagaagccccggatctgcacccgcgaggagttcacccggaaggtgcgcagcaacgccgccatcggcgcggtcttcgtggacgagaaccagtggaactccgccaaggaggccgtggaggacgagcggttctgggacctggtccaccgcgagcgggagctgcacaagcaggggaagtgcgccacgtgcgtgtacaacatgatgggcaagcgcgagaagaagctcggggagttcggcaaggcgaagggcagccgggccatctggtacatgtggctgggggcccgcttcctggagttcgaggccctcggcttcatgaacgaggaccactggttctcccgggagaacagcctgtccggggtggagggcgaggggctgcacaagctcggctacatcctgcgcgacatcagcaagatcccgggcgggaacatgtacgccgacgacaccgcgggctgggacacccggatcaccgaggacgacctgcagaacgaggccaagatcacggacatcatggagcccgagcacgccctcctggccacctccatcttcaagctgacctaccagaacaaggtcgtgcgcgtgcagcgccccgccaagaacgggaccgtcatggacgtgatcagccggcgcgaccagcggggctccggccaggtggggacgtacggcctcaacaccttcaccaacatggaggtccagctgatccgccagatggagagcgaggggatcttcctgccctccgagctcgagaccccgaacctggcggagcgggccctggactggctcgagaagcacggcgccgagcgcctgaagcggatggccatcagcggggacgactgcgtggtgaagcccatcgacgaccgcttcgccacggcgctgaccgccctcaacgacatgggcaaggtccggaaggacatcccccagtgggagccctccaagggctggaacgactggcagcaggtcccgttctgcagccaccacttccaccagctgatcatgaaggacgggcgcgagatcgtggtcccctgccggaaccaggacgagctggtgggccgcgcccgggtgtcccagggggccggctggagcctccgcgagaccgcctgcctggggaagtcctacgcgcagatgtggcagctgatgtacttccaccggcgcgacctccggctggccgccaacgccatctgcagcgcggtccccgtggactgggtgcccaccagccgcaccacgtggtccatccacgcccaccaccagtggatgaccaccgaggacatgctgagcgtctggaaccgggtgtggatcgaggagaacccgtggatggaggacaagacccacgtgtccagctgggaggaggtcccctacctcggcaagcgcgaggaccagtggtgcggctccctgatcgggctgacggcccgcgccacctgggccaccaacatccaggtggcgatcaaccaggtgcggcgcctcatcggcaacgagaactacctggactacatgaccagcatgaagcggttcaagaacgagtccgaccccgagggggccctgtggtga

SEQ ID NO: 8265 - RNA, 9879 nt, synthetic construct
  misc_feature 1..9879: note = derived and/or modified CDS sequence (opt1) from DENV-1__GU056029__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgagaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgccccacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcgcgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgtccaggggaagaagatgatccgcccccagcccatggagcacaagtactcctggaagtcctggggcaaggcgaagatcatcggcgccgacatccagaacacgaccttcatcatcgacgggcccgacaccccggagtgccccgacggccagcgggcctggaacatctgggaggtggaggactacgggttcggcgtgttcaccacgaacatctggctgaagctgcgcgactcctacacccagatgtgcgaccaccggctcatgagcgccgcgatcaaggactccaaggccgtccacgccgacatgggctactggatcgagagcgagaagaacgagacctggaagctggcccgcgcctccttcatcgaggtgaagacctgcacgtggcccaagagccacaccctgtggtccaacggggtgctcgagagcgagatgatcatccccaagatctacggcgggccgatctcccagcacaactaccggcccggctacttcacccagaccgcggggccctggcacctgggcaagctggagctcgacttcgacctgtgcgagggcacgaccgtcgtggtggacgagcactgcgggaaccgcggcccgagcctgcggaccaccacggtcaccgggaagatcatccacgagtggtgctgccgctcctgcaccctgccgcccctgcggttccgcggcgaggacgggtgctggtacggcatggagatccggcccgtgaaggagaaggaggagaacctggtgcgcagcatggtctccgccggcagcggggaggtggacagcttctccctcggcatcctgtgcgtgagcatcatgatcgaggaggtcatgcggtcccgctggagccgcaagatgctgatgaccgggacgctcgccgtgttcctgctgctcatcatgggccagctgacctggaacgacctgatccggctctgcatcatggtgggggccaacgcctccgaccgcatgggcatgggcaccacctacctggcgctgatggccacgttcaagatgcggccgatgttcgccgtcgggctcctgttccgccggctgaccagccgcgaggtgctcctgctgaccatcggcctctccctggtcgccagcgtggagctgcccaactccctcgaggagctgggggacggcctggccatgggcatcatgatgctcaagctgctgaccgagttccagccccaccagctctggacgaccctgctgagcctcaccttcgtgaagaccgcgctgtccctggactacgcctggaagacgaccgccatggtcctcagcatcgtgtccctgttccccctgtgcctcagcaccacctcccagaagacgacctggctgccggtgctgctcgggagcttcggctgcaagcccctgaccatgttcctgatcaccgagaacaagatctgggggcggaagtcctggcccctcaacgagggcatcatggccatcgggatcgtcagcatcctgctgtccagcctcctgaagaacgacgtgcccctggcgggcccgctcatcgccggcgggatgctgatcgcctgctacgtgatcagcggctccagcgccgacctgtccctcgagaaggccgcggaggtcagctgggagcaggaggccgagcactccggggccagccacaacatcctggtggaggtgcaggacgacggcaccatgaagatcaaggacgaggagcgcgacgacacgctgaccatcctcctgaaggccaccctgctcgccgtctccggggtgtaccccatgagcatccccgcgaccctgttcgtgtggtacttctggcagaagaagaagcagcggtccggcgtcctgtgggacacgcccagcccgcccgaggtggagcgcgccgtgctcgacaacggcatctaccggatcctgcagcgcgggctgctgggccggtcccaggtcggggtgggcgtgttccaggacggggtcttccacaccatgtggcacgtgacccgcggcgccgtgctcatgtaccagggcaagcggctggagcccagctgggcctccgtcaagaaggacctgatcagctacgggggcgggtggcgcttccagggctcctggaacaccggggaggaggtccaggtgatcgccgtcgagcccggcaagaacccgaagaacgtgcagacgacccccggcaccttcaagacccccgagggggaggtgggcgcgatcgccctcgacttcaagcccgggacgagcggctccccgatcgtcaaccgggagggcaagatcgtggggctgtacggcaacggggtggtcaccaccagcggcacctacgtgtccgccatcgcccaggccaaggcgagccaggaggggcccctgcccgagatcgaggacgaggtgttcaagaagcgcaacctcacgatcatggacctgcacccgggcagcggcaagacccggcgctacctgcccgccatcgtccgggaggccatcaagcgcaagctccgcaccctgatcctggcccccacccgggtggtggcgtccgagatggccgaggccctcaaggggatgcccatccgctaccagacgaccgccgtcaagagcgagcacaccggccgggagatcgtggacctgatgtgccacgccaccttcacgatgcgcctgctctccccggtgcgggtccccaactacaacatgatcatcatggacgaggcgcacttcaccgaccccgccagcatcgccgcccgcgggtacatctccacccgggtgggcatgggggaggccgcggccatcttcatgaccgccacgcccccgggcagcgtggaggccttcccccagtccaacgccgtcatccaggacgaggagcgcgacatccccgagcggagctggaactccggctacgactggatcaccgacttccccgggaagaccgtgtggttcgtgccgagcatcaagtccggcaacgacatcgcgaactgcctgcgcaagaacgggaagcgggtcatccagctgagccgcaagaccttcgacacggagtaccagaagaccaagaacaacgactgggactacgtggtgaccaccgacatctccgagatgggcgccaacttccgggccgaccgcgtcatcgacccccggcgctgcctcaagcccgtgatcctgaaggacgggcccgagcgggtcatcctggccggcccgatgcccgtgacggtggcgagcgccgcccagcgccggggccgcatcgggcgcaaccagaacaaggagggcgaccagtacgtctacatggggcagcccctcaacaacgacgaggaccacgcccactggaccgaggccaagatgctgctggacaacatcaacacccccgagggcatcatcccggccctcttcgagcccgagcgggagaagtccgccgccatcgacggggagtaccgcctgcggggcgaggcccgcaagaccttcgtggagctgatgcggcgcggcgacctccccgtgtggctgagctacaaggtcgcctccgaggggttccagtacagcgaccggcgctggtgcttcgacggcgagcggaacaaccaggtgctggaggagaacatggacgtggagatctggacgaaggagggggagcgcaagaagctccggccccgctggctggacgcgcggacctactccgacccgctggccctccgcgagttcaaggagttcgccgccggccggcgcagcgtcagcggcgacctgatcctggagatcgggaagctcccccagcacctgaccctgcgggcccagaacgcgctcgacaacctggtgatgctgcacaactccgagcagggcgggaaggcctaccgccacgccatggaggagctccccgacaccatcgagaccctgatgctgctcgccctgatcgcggtgctgacgggcggggtcaccctcttcttcctgagcggcaagggcctggggaagacctccatcggcctcctgtgcgtgaccgccagctccgccctgctctggatggccagcgtggagccccactggatcgccgcgtccatcatcctggagttcttcctgatggtcctcctgatcccggagcccgaccggcagcgcacgccccaggacaaccagctggcctacgtggtgatcgggctcctgttcatgatcctgaccgtcgccgccaacgagatgggcctcctggagaccaccaagaaggacctggggatcggctacgtggccgcggagaaccaccagcacgccacgatgctcgacgtggacctgcacccggccagcgcctggaccctgtacgccgtcgcgaccaccgtgatcacgcccatgatgcggcacaccatcgagaacaccaccgccaacatctccctcacggccatcgccaaccaggccgcgatcctgatgggcctggacaaggggtggcccatcagcaagatggacatcggcgtgcccctcctggccctggggtgctactcccaggtcaacccgctcaccctgaccgccgccgtgctgatgctcgtggcgcactacgccatcatcggccccgggctgcaggccaaggccacccgcgaggcccagaagcgcacggcggccggcatcatgaagaaccccaccgtcgacggcatcgtggccatcgacctggaccccgtggtctacgacgccaagttcgagaagcagctcgggcagatcatgctgctgatcctctgcaccagccagatcctgctgatgcggaccacgtgggccctctgcgagtccatcaccctggcgaccggcccgctgaccacgctctgggaggggagccccggcaagttctggaacaccaccatcgccgtgtccatggccaacatcttccgcggcagctacctggccggggccggcctggcgttctccctcatgaagtccctcgggggcgggcggcgcgggaccggcgcccagggggagacgctgggcgagaagtggaagcggcagctcaaccagctgtccaagagcgagttcaacacctacaagcgcagcgggatcatggaggtggaccggtccgaggccaaggagggcctgaagcgcggggagaccaccaagcacgccgtcagccggggcacggcgaagctccgctggttcgtggagcggaacctggtgaagcccgagggcaaggtcatcgacctggggtgcggccgcgggggctggtcctactactgcgccgggctgaagaaggtgaccgaggtgaagggctacaccaagggcgggcccggccacgaggagccgatccccatggccacctacgggtggaacctcgtcaagctgcacagcggcaaggacgtgttcttcatgccgcccgagaagtgcgacaccctgctctgcgacatcggggagtccagcccgaaccccacgatcgaggagggccggaccctgcgcgtgctgaagatggtcgagccctggctccggggcaaccagttctgcatcaagatcctgaacccctacatgccgtccgtggtggagaccctggagcagatgcagcgcaagcacgggggcatgctcgtccggaaccccctgagccgcaactccacccacgagatgtactgggtgagctgcgggacgggcaacatcgtgtccgccgtcaacatgaccagccggatgctgctcaaccgcttcaccatggcccaccgcaagcccacctacgagcgggacgtggacctgggcgcggggacgcgccacgtggccgtcgagcccgaggtggccaacctggacatcatcggccagcggatcgagaacatcaagaacgagcacaagtccacctggcactacgacgaggacaacccgtacaagacctgggcctaccacgggagctacgaggtcaagccctccggcagcgcctccagcatggtgaacggggtggtccgcctcctgaccaagccctgggacgtgatccccatggtgacgcagatcgcgatgaccgacaccaccccgttcggccagcagcgggtcttcaaggagaaggtggacacgcgcacgccccgggccaagcgcggcaccacccagatcatggaggtgacggccaagtggctgtgggggttcctctcccggaacaagaagccccgcatctgcacccgggaggagttcacccgcaaggtccggagcaacgccgccatcggcgcggtgttcgtggacgagaaccagtggaacagcgccaaggaggccgtcgaggacgagcgcttctgggacctggtgcaccgggagcgcgagctgcacaagcaggggaagtgcgcgacctgcgtgtacaacatgatgggcaagcgggagaagaagctcggggagttcggcaaggcgaagggctcccgcgccatctggtacatgtggctgggggcccggttcctggagttcgaggccctcggcttcatgaacgaggaccactggttcagccgcgagaactccctgagcggggtcgagggcgaggggctgcacaagctcggctacatcctgcgggacatctccaagatcccgggcgggaacatgtacgccgacgacacggcgggctgggacacccgcatcaccgaggacgacctgcagaacgaggccaagatcaccgacatcatggagcccgagcacgccctcctggccacgagcatcttcaagctgacctaccagaacaaggtggtgcgcgtccagcggcccgccaagaacgggaccgtgatggacgtgatctcccgccgggaccagcgcggcagcggccaggtcgggacctacggcctcaacacgttcaccaacatggaggtgcagctgatccggcagatggagtccgaggggatcttcctgcccagcgagctcgagaccccgaacctggcggagcgcgccctggactggctcgagaagcacggcgccgagcggctgaagcgcatggccatctccggggacgactgcgtggtcaagcccatcgacgaccggttcgccaccgcgctgacggccctcaacgacatgggcaaggtgcgcaaggacatcccccagtgggagcccagcaagggctggaacgactggcagcaggtcccgttctgctcccaccacttccaccagctgatcatgaaggacgggcgggagatcgtcgtgccctgccgcaaccaggacgagctggtgggccgggcccgcgtcagccagggggccggctggtccctccgggagaccgcctgcctgggcaagagctacgcgcagatgtggcagctgatgtacttccaccgccgggacctccgcctggccgccaacgccatctgctccgcggtgcccgtggactgggtccccaccagccggaccacctggagcatccacgcccaccaccagtggatgacgaccgaggacatgctgtccgtgtggaaccgcgtgtggatcgaggagaacccgtggatggaggacaagacccacgtcagctcctgggaggaggtgccctacctcggcaagcgcgaggaccagtggtgcggcagcctgatcgggctgaccgcccgggccacgtgggccaccaacatccaggtggcgatcaaccaggtccgccggctcatcggcaacgagaactacctggactacatgacctccatgaagcgcttcaagaacgagagcgactccgagggggccctgtggtga

SEQ ID NO: 8266 - RNA, 9879 nt, synthetic construct
  misc_feature 1..9879: note = derived and/or modified CDS sequence (opt1) from DENV-1__GU056030__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgagaagcggtccgtggccctggcgccccacgtgggcctggggctcgagacgcgcaccgagacctggatgagctccgagggcgcctggaagcagatccagcgggtcgagacctgggccctgcgccacccggggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgcggtacgagggcaccgacgccccctgcaagatccccttctccacccaggacgagaagggggtgacccagaacggccgcctgatcacggccaacccgatcgtcaccgacaaggagaagcccgtgaacatcgagaccgagccgcccttcggggagagctacatcgtggtcggcgccggcgagaaggcgctcaagctgtcctggttcaagcgggggagctccatcggcaagatgttcgaggccaccgcccgcggggcccgccggatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcgcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctgcgggactcctacacccagatgtgcgaccaccgcctcatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctgtggtccaacggggtcctcgagagcgagatgatcatccccaagatctacggcgggccgatctcccagcacaactaccgccccggctactacacccagaccgccgggccctggcacctgggcaagctggagctcgacttcgacctgtgcgagggcacgaccgtggtggtcgacgagcactgcgggaaccggggcccgagcctgcgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctggtccggagcatggtgtccgccggcagcggggaggtggacaacttcagcctcggcatcctgtgcgtctccatcatgatcgaggaggtgatgcgcagccgctggtcccggaagatgctgatgaccgggacgctcgccgtgttcctgctgctcatcatgggccagctgacctggaacgacctgatccgcctctgcatcatggtcggggccaacgcgagcgacggcatgggcatggggaccacctacctggccctgatggccacgttcaagatgcggccgatgttcgccgtgggcctcctgttccgccggctgacctcccgcgaggtgctcctgctgaccatcgggctcagcctggtcgcctccgtggagctgcccaacagcctcgaggagctgggcgacggcctggcgatggggatcatgatgctcaagctgctgaccgagttccagccccaccagctctggacgaccctgctgtccctcaccttcgtcaagaccacgctgagcctggactacgcctggaagaccaccgccatggtgctctccatcgtgagcctgttccccctgtgcctctccaccacgagccagaagaccacctggctgccggtcctgctcggctccttcgggtgcaagcccctgaccatgttcctgatcaccgagaacaagatctggggccgcaagagctggcccctcaacgaggggatcatggccatcggcatcgtgtccatcctgctgagctccctcctgaagaacgacgtgcccctggcgggcccgctcatcgccgggggcatgctgatcgcctgctacgtcatcagcgggagctccgccgacctgagcctcgacaaggccgcggaggtgtcctgggagcaggaggccgagcacagcggcgcctcccacaacatcagcgtggaggtccaggacgacgggacgatgaagatcaaggacgaggagcgcgacgacaccctgaccatcctgctcaaggccaccctgctggccgtgtccggcgtgtaccccatgagcatccccgcgaccctcttcgtctggtacttctggcagaagaagaagcagcggtccggcgtgctgtgggacacccccagcccgcccgaggtggagcgcgccgtcctggacgacgggatctaccggatcctccagcgcggcctgctggggcggtcccaggtgggcgtgggggtcttccaggacggcgtgttccacaccatgtggcacgtgacccgcggcgccgtcctgatgtaccaggggaagcggctcgagcccagctgggcctgcgtgaagaaggacctgatctcctacggcgggggctggcgcttccaggggagctggaacacgggcgaggaggtgcaggtcatcgccgtggagcccggcaagaacccgaagaacgtgcagaccacccccgggaccttcaagacgcccgagggcgaggtcggggcgatcgccctggacttcaagcccggcacctccggcagcccgatcgtgaaccgggaggggaagatcgtgggcctctacgggaacggcgtcgtgaccacctccgggacgtacgtgagcgccatcgcccaggccaaggcgtcccaggagggccccctgcccgagatcgaggacgaggtcttcaagaagcgcaacctgaccatcatggacctccacccgggcagcgggaagacccggcgctacctgcccgccatcgtgcgggaggccatcaagcgcaagctgcgcaccctcatcctggcccccacgcgggtggtcgcgagcgagatggccgaggccctgaagggcatgcccatccgctaccagaccaccgccgtgaagtccgagcacaccgggcgggagatcgtggacctcatgtgccacgccacgttcaccatgcgcctgctgagcccggtccgggtgcccaactacaacatgatcatcatggacgaggcgcacttcaccgaccccgcctccatcgccgcccgcggctacatcagcacccgggtggggatgggcgaggccgcggccatcttcatgacggccacgccgcccggctccgtcgaggccttcccccagagcaacgccgtgatccaggacgaggagcgcgacatccccgagcggtcctggaacagcgggtacgactggatcaccgacttccccggcaagaccgtgtggttcgtcccctccatcaagagcgggaacgacatcgcgaactgcctccgcaagaacggcaagcgggtgatccagctgtcccgcaagacgttcgacaccgagtaccagaagaccaagaacaacgactgggactacgtggtcaccacggacatcagcgagatgggggccaacttccgggccgaccgcgtgatcgacccccggcgctgcctgaagcccgtgatcctcaaggacggccccgagcgggtcatcctggccggcccgatgcccgtgaccgtcgcgtccgccgcccagcgccgggggcgcatcggccgcaaccagaacaaggagggggaccagtacgtgtacatgggccagcccctgaacaacgacgaggaccacgcccactggaccgaggccaagatgctcctggacaacatcaacacccccgaggggatcatcccggcgctgttcgagcccgagcgggagaagtccgccgccatcgacggcgagtaccgcctccggggcgaggcccgcaagacgttcgtggagctgatgcggcgcggggacctgcccgtctggctctcctacaaggtggccagcgagggcttccagtactccgaccggcgctggtgcttcgacggggagcggaacaaccaggtgctggaggagaacatggacgtcgagatctggaccaaggagggcgagcgcaagaagctgcggccccgctggctcgacgcgcggacctacagcgacccgctggccctgcgcgagttcaaggagttcgccgccggccggcgctccgtgagcggggacctcatcctggagatcggcaagctgccccagcacctcaccctgcgggcccagaacgcgctggacaacctcgtgatgctgcacaacagcgagcagggcgggaaggcctaccgccacgccatggaggagctgcccgacaccatcgagacgctcatgctgctggccctcatcgcggtcctgaccgggggcgtgaccctgttcttcctctccggcaaggggctgggcaagaccagcatcgggctgctctgcgtgacggcctccagcgccctgctgtggatggcctccgtcgagccccactggatcgccgcgagcatcatcctcgagttcttcctgatggtgctgctcatcccggagcccgaccggcagcgcacgccccaggacaaccagctggcctacgtggtcatcggcctcctcttcatgatcctgaccgtggccgccaacgagatggggctgctcgagaccacgaagaaggacctgggcatcggctacgtggccgcggagaaccaccagcacgccaccatgctggacgtcgacctccacccggcctccgcctggaccctgtacgccgtggcgaccacggtgatcacccccatgatgcggcacaccatcgagaacaccacggccaacatcagcctgaccgccatcgccaaccaggccgcgatcctcatggggctggacaagggctggcccatctccaagatggacatcggggtccccctgctcgccctgggctgctacagccaggtgaacccgctgaccctcaccgccgccgtgctgatgctggtcgcgcactacgccatcatcgggcccggcctccaggccaaggccacgcgcgaggcccagaagcgcaccgcggccggcatcatgaagaaccccaccgtggacgggatcgtggccatcgacctggaccccgtcgtgtacgacgtgaagttcgagaagcagctgggccagatcatgctcctgatcctgtgcacctcccagatcctcctgatgcggacgacctgggccctgtgcgagagcatcaccctcgccaccgggccgctgacgaccctgtgggagggctcccccggcaagttctggaacaccaccatcgcggtcagcatggccaacatcttccgcgggtcctacctcgccggcgccgggctggccttcagcctgatgaagtccctcggcgggggccggcgcggcacgggggcgcagggcgagaccctgggggagaagtggaagcggcagctgaaccagctcagcaagtccgagttcaacacctacaagcgcagcggcatcatggaggtggaccggagcgaggccaaggaggggctgaagcgcggcgagaccacgaaccacgccgtgtcccggggcaccgccaagctgcgctggttcgtcgagcggaacctcgtgaagcccgaggggaaggtgatcgacctgggctgcgggcgcggcgggtggagctactactgcgcgggcctgaagaaggtcaccgaggtgaagggctacaccaagggcgggcccgggcacgaggagccgatccccatggccacctacggctggaacctggtgaagctccactccgggaaggacgtcttcttcatgccgcccgagaagtgcgacacgctgctgtgcgacatcggcgagagctccccgaaccccaccatcgaggagggccggaccctccgcgtgctgaagatggtggagccctggctgcgggggaaccagttctgcatcaagatcctcaacccctacatgccgagcgtcgtggagaccctggagcagatgcagcgcaagcacggcgggatgctggtgcggaaccccctctcccgcaacagcacgcacgagatgtactgggtctcctgcggcaccggcaacatcgtgagcgccgtgaacatgacctcccggatgctgctgaaccgcttcaccatggcccaccgcaagcccacgtacgagcgggacgtcgacctcggggccggcacccgccacgtgaccgtggagcccgaggtcgcgaacctggacatcatcgggcagcggatcgagaacatcaagaacgagcacaagagcacctggcactacgacgaggacaacccgtacaagacgtgggcctaccacggctcctacgaggtgaagcccagcgggtccgccagctccatggtcaacggcgtggtgcgcctgctcaccaagccctgggacgtcatccccatggtgacccagatcgccatgaccgacacgaccccgttcggccagcagcgggtgttcaaggagaaggtcgacacccgcacgccccgggccaagcgcgggacgacccagatcatggaggtgaccgcgaagtggctgtggggcttcctgagccggaacaagaagccccgcatctgcacccgggaggagttcacgcgcaaggtgcggtccaacgccgccatcggggccgtcttcgtggacgagaaccagtggaacagcgccaaggaggcggtggaggacgagcgcttctgggacctcgtccaccgggagcgcgagctgcacaagcagggcaagtgcgcgacctgcgtgtacaacatgatggggaagcgggagaagaagctgggcgagttcggcaaggccaaggggagccgcgccatctggtacatgtggctcggcgcgcggttcctggagttcgaggccctggggttcatgaacgaggaccactggttctcccgcgagaacagcctctccggcgtggagggggagggcctgcacaagctgggctacatcctccgggacatcagcaagatccccggcgggaacatgtacgccgacgacaccgccgggtgggacacccgcatcacggaggacgacctgcagaacgaggccaagatcaccgacatcatggagcccgagcacgcgctgctcgccacctccatcttcaagctgacctaccagaacaaggtcgtgcgcgtgcagcggcccgccaagaacgggacggtcatggacgtgatcagccgccgggaccagcgcggctccggccaggtgggcacctacgggctgaacaccttcaccaacatggaggtccagctcatccggcagatggagagcgagggcatcttcctgccctccgagctggagacgccgaacctcgccgagcgcgtgctggactggctggagaagcacggggccgagcggctcaagcgcatggcgatcagcggcgacgactgcgtggtcaagcccatcgacgaccggttcgccaccgccctgaccgccctgaacgacatgggcaaggtgcgcaaggacatcccccagtgggagccctccaaggggtggaacgactggcagcaggtcccgttctgcagccaccacttccaccagctcatcatgaaggacggccgggagatcgtcgtgccctgccgcaaccaggacgagctggtggggcgggcccgcgtctcccagggcgcggggtggagcctgcgggagaccgcctgcctcggcaagtcctacgcccagatgtggcagctgatgtacttccaccgccgggacctgcgcctcgccgccaacgcgatctgcagcgccgtgcccgtggactgggtccccacctcccggacgacctggagcatccacgcccaccaccagtggatgaccaccgaggacatgctgagcgtgtggaaccgcgtgtggatcgaggagaacccgtggatggaggacaagacgcacgtctccagctgggaggaggtgccctacctgggcaagcgcgaggaccagtggtgcgggtccctcatcggcctgaccgcccgggcgacctgggccaccaacatccaggtggccatcaaccaggtccgccggctgatcgggaacgagaactacctcgactacatgacgagcatgaagcgcttcaagaacgagtccgaccccgagggcgccctgtggtga

SEQ ID NO: 8267 - RNA, 9879 nt, synthetic construct
  misc_feature 1..9879: note = derived and/or modified CDS sequence (opt1) from DENV-1__GU056031__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgagaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctgtggtccaacggggtgctcgagagcgagatgatcatccccaagatctacggcgggccgatctcccagcacaactaccggcccggctacttcacccagaccgccgggccctggcacctgggcaagctggagctcgacttcaacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgtgagcatcatgatcgaggaggtgatgcggtcccgctggagccgcaagatgctgatgaccgggacgctcgccgtcttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtggggctcctgttccgccggctgaccagccgcgaggtcctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatggtgctcagcatcgtctccctgttccccctgtgcctcagcaccacgtcccagaagaccacctggctgccggtgctgctcgggagcttcggctgcaagccctccaccatgttcctgatcaccgagaacaagatctgggggcgcaagagctggcccctgaacgagggcatcatggccatcgggatcgtgtccatcctcctgagcagcctgctcaagaacgacgtccccctggcgggcccgctgatcgccggcgggatgctcatcgcctgctacgtgatctccggcagctccgccgacctgagcctggagaaggccgcggaggtgtcctgggagcaggaggccgagcacagcggggcctcccacaacatcctcgtcgaggtgcaggacgacggcacgatgaagatcaaggacgaggagcgcgacgacaccctgaccatcctgctcaaggccaccctgctggccgtgagcggggtctaccccatgtccatccccgcgaccctcttcgtgtggtacttctggcagaagaagaagcagcggagcggcgtgctgtgggacaccccctccccgcccgaggtcgagcgcgccgtgctggacgacggcatctaccggatcctccagcgcgggctgctgggccggagccaggtgggggtcggcgtgttccaggacggggtgttccacaccatgtggcacgtcacccgcggcgccgtgctgatgtaccagggcaagcggctcgagccctcctgggccagcgtgaagaaggacctgatctcctacgggggcgggtggcgcttccagggcagctggaacacgggggaggaggtccaggtgatcgccgtggagcccggcaagaacccgaagaacgtccagaccacccccggcaccttcaagacgcccgagggggaggtgggcgcgatcgccctggacttcaagcccgggacctccggcagcccgatcgtgaaccgggagggcaagatcgtcgggctctacggcaacggggtggtgaccacctccggcacgtacgtcagcgccatcgcccaggccaaggcgagccaggaggggcccctgcccgagatcgaggacgaggtgttcaagaagcgcaacctgaccatcatggacctccacccgggctccggcaagacccggcgctacctgcccgccatcgtgcgggaggccatcaagcgcaagctgcgcaccctcatcctggcccccacgcgggtcgtggcgagcgagatggccgaggccctgaaggggatgcccatccgctaccagaccaccgccgtgaagtccgagcacaccggccgggagatcgtcgacctcatgtgccacgccacgttcaccatgcgcctgctgagcccggtgcgggtgcccaactacaacatgatcatcatggacgaggcgcacttcaccgaccccgcctccatcgccgcccgcgggtacatcagcacccgggtcggcatgggggaggccgcggccatcttcatgacggccacgccgcccggctccgtggaggccttcccccagagcaacgccgtgatccaggacgaggagcgcgacatccccgagcggtcctggaacagcggctacgactggatcaccgacttccccgggaagaccgtctggttcgtgccctccatcaagagcggcaacgacatcgcgaactgcctccgcaagaacgggaagcgggtgatccagctgtcccgcaagacgttcgacaccgagtaccagaagaccaagaacaacgactgggactacgtcgtgaccacggacatcagcgagatgggcgccaacttccgggccgaccgcgtgatcgacccccggcgctgcctgaagcccgtcatcctcaaggacgggcccgagcgggtgatcctggccggcccgatgcccgtcaccgtggcgtccgccgcccagcgccggggccgcatcgggcgcaaccagaacaaggagggcgaccagtacgtgtacatggggcagcccctgaacaacgacgaggaccacgcccactggaccgaggccaagatgctcctggacaacatcaacacccccgagggcatcatcccggcgctgttcgagcccgagcgggagaagtccgccgccatcgacggggagtaccgcctccggggcgaggcccgcaagacgttcgtcgagctgatgcggcgcggcgacctgcccgtgtggctctcctacaaggtggccagcgaggggttccagtactccgaccggcgctggtgcttcgacggcgagcggaacaaccaggtcctggaggagaacatggacgtggagatctggaccaaggagggggagcgcaagaagctgcggccccgctggctcgacgcgcggacctacagcgacccgctggccctgcgcgagttcaaggagttcgccgccggccggcgcagcgtgtccggcgacctcatcctggagatcgggaagctgccccagcacctcaccctgcgggcccagaacgcgctggacaacctcgtcatgctgcacaacagcgagcagggcgggaaggcctaccgccacgccatggaggagctgcccgacaccatcgagacgctcatgctgctggccctcatcgcggtgctgaccggcggggtgaccctgttcttcctctccggcaagggcctggggaagaccagcatcggcctgctctgcgtcacggcctccagcgccctgctgtggatggcctccgtggagccccactggatcgccgcgagcatcatcctcgagttcttcctgatggtgctgctcatcccggagcccgaccggcagcgcacgccccaggacaaccagctggcctacgtcgtgatcgggctcctcttcatgatcctgaccgtggccgccaacgagatgggcctgctcgagaccacgaagaaggacctggggatcggctacgtcgccgcggagaaccaccagcacgccaccatgctggacgtggacctccacccggcctccgcctggaccctgtacgccgtggcgaccacggtcatcacccccatgatgcggcacaccatcgagaacaccacggccaacatcagcctgaccgccatcgccaaccaggccgcgatcctcatgggcctggacaaggggtggcccatctccaagatggacatcggcgtgcccctgctcgccctggggtgctacagccaggtgaacccgctgaccctcaccgccgccgtcctgatgctggtggcgcactacgccatcatcggccccgggctccaggccaaggccacgcgcgaggcccagaagcgcaccgcggccggcatcatgaagaaccccaccgtggacggcatcgtcgccatcgacctggaccccgtggtgtacgacgccaagttcgagaagcagctggggcagatcatgctcctgatcctgtgcacctcccagatcctcctgatgcggacgacctgggccctgtgcgagagcatcaccctcgcgaccggcccgctgacgaccctgtgggaggggtcccccggcaagttctggaacaccaccatcgccgtcagcatggccaacatcttccgcggctcctacctcgccggggccggcctggcgttcagcctgatgaagtccctcgggggcgggcggcgcggcacgggcgcccagggggagaccctgggcgagaagtggaagcggcagctgaaccagctcagcaagagcgagttcaacacctacaagcgctccgggatcatggaggtggaccggagcgaggccaaggagggcctgaagcgcggggagaccacgaagcacgccgtgtcccggggcaccgcgaagctgcgctggttcgtcgagcggaacctcgtgaagcccgagggcaaggtgatcgacctggggtgcggccgcgggggctggagctactactgcgccgggctgaagaaggtcaccgaggtgaagggctacaccaagggcgggcccggccacgaggagccgatccccatggccacctacgggtggaacctggtgaagctccactccggcaaggacgtcttcttcatgccgcccgagaagtgcgacacgctgctgtgcgacatcggggagagctccccgaaccccaccatcgaggagggccggaccctccgcgtgctgaagatggtggagccctggctgcggggcaaccagttctgcatcaagatcctcaacccctacatgccgagcgtcgtggagaccctggagcagatgcagcgcaagcacgggggcatgctggtgcggaaccccctctcccgcaacagcacgcacgagatgtactgggtctcctgcgggaccggcaacatcgtgagcgccgtgaacatgacctcccggatgctgctgaaccgcttcaccatggcccaccgcaagcccacgtacgagcgggacgtcgacctcggcgcggggacccgccacgtggccgtggagcccgaggtcgccaacctggacatcatcggccagcggatcgagaacatcaagaacgagcacaagagcacctggcactacgacgaggacaacccgtacaagacctgggcctaccacgggtcctacgaggtgaagcccagcggctccgccagctccatggtcaacggggtggtgcgcctgctcacgaagccctgggacgtcatccccatggtgacccagatcgcgatgaccgacaccacgccgttcggccagcagcgggtgttcaaggagaaggtcgacacccgcacgccccgggccaagcgcggcaccacgcagatcatggaggtgaccgccaagtggctgtgggggttcctgagccggaacaagaagccccgcatctgcacccgggaggagttcacccgcaaggtgcggagcaacgccgccatcggcgcggtcttcgtggacgagaaccagtggaactccgccaaggaggccgtggaggacgagcgcttctgggacctcgtccaccgggagcgcgagctgcacaagcaggggaagtgcgccacgtgcgtgtacaacatgatgggcaagcgggagaagaagctgggggagttcggcaaggcgaagggcagccgcgccatctggtacatgtggctcggggcccggttcctggagttcgaggccctgggcttcatgaacgaggaccactggttctcccgcgagaacagcctctccggggtggagggcgaggggctgcacaagctgggctacatcctccgggacatcagcaagatcccgggcgggaacatgtacgccgacgacaccgcgggctgggacacccgcatcaccgaggacgacctgcagaacgaggccaagatcacggacatcatggagcccgagcacgccctgctcgccacctccatcttcaagctgacctaccagaacaaggtcgtgcgcgtgcagcggcccgccaagaacgggaccgtcatggacgtgatcagccgccgggaccagcgcggctccggccaggtggggacgtacggcctgaacaccttcaccaacatggaggtccagctcatccggcagatggagagcgaggggatcttcctgccctccgagctggagaccccgaacctcgcggagcgcgccctggactggctggagaagcacggcgccgagcggctcaagcgcatggccatcagcggggacgactgcgtggtgaagcccatcgacgaccggttcgccacggcgctgaccgccctgaacgacatgggcaaggtccgcaaggacatcccccagtgggagccctccaagggctggaacgactggcagcaggtcccgttctgcagccaccacttccaccagctcatcatgaaggacgggcgggagatcgtggtcccctgccgcaaccaggacgagctggtgggccgggcccgcgtgtcccagggggccggctggagcctgcgggagaccgcctgcctcgggaagtcctacgcgcagatgtggcagctgatgtacttccaccgccgggacctgcgcctcgccgccaacgccatctgcagcgcggtccccgtggactgggtgcccaccagccggaccacgtggtccatccacgcccaccaccagtggatgaccaccgaggacatgctgagcgtctggaaccgcgtgtggatcgaggagaacccgtggatggaggacaagacccacgtgtccagctgggaggaggtcccctacctgggcaagcgcgaggaccagtggtgcggctccctcatcgggctgacggcccgggccacctgggccaccaacatccaggtggcgatcaaccaggtgcgccggctgatcggcaacgagaactacagcgactacatgacctccatgaagcgcttcaagaacgagagcgaccccgagggggccctctggtga

SEQ ID NO: 8268 - RNA, 9879 nt, synthetic construct
  misc_feature 1..9879: note = derived and/or modified CDS sequence (opt1) from DENV-1__GU056032__SS-prME
  source 1..9879: mol_type = other RNA
agcgtggccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggcgctggcgccccacgtgggcctggggctcgagacccgcaccgagacctggatgagctccgagggcgcctggaagcagatccagcgggtcgagacctgggccctgcgccaccccgggttcaccgtgatcgcgctgttcctcgcccacgccatcggcacgagcatcacccagaaggggatcatcttcatcctgctgatgctcgtgaccccctccatggccatgcggtgcgtcggcatcggcaaccgcgacttcgtggaggggctgagcggcgccacctgggtggacgtcgtgctggagcacgggtcctgcgtgacgaccatggcgaagaacaagcccaccctcgacatcgagctgctgaagaccgaggtcacgaaccccgccgtgctccggaagctgtgcatcgaggccaagatcagcaacaccaccaccgactcccgctgcccgacgcagggcgaggccaccctggtggaggagcaggacgccaacttcgtctgccggcgcaccttcgtggaccggggctgggggaacggctgcggcctcttcggcaaggggagcctgctgacctgcgcgaagttcaagtgcgtgacgaagctcgagggcaagatcgtccagtacgagaacctgaagtactccgtgatcgtgaccgtccacaccggcgaccagcaccaggtggggaacgagaccacggagcacggcaccatcgccaccatcacgccccaggcccccaccagcgagatccagctgacggactacggggccctcaccctggactgcagcccccggaccggcctggacttcaacgagatggtcctcctgaccatgaaggagaagtcctggctggtgcacaagcagtggttcctcgacctgccgctgccctggacgtccggggccagcaccagccaggagacctggaaccggcaggacctcctggtgaccttcaagacggcgcacgccaagaagcaggaggtcgtggtgctgggctcccaggagggcgccatgcacaccgccctcaccggggccaccgagatccagacgagcggcaccaccaccatcttcgcggggcacctgaagtgccgcctgaagatggacaagctcacgctgaagggcacctcctacgtcatgtgcaccgggagcttcaagctggagaaggaggtggccgagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggcggacagcccgaagcgcctgagcgccgccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgcgaacggcatcctggcccaggggaagaagatgatccggccccagcccatggagcacaagtactcctggaagtcctggggcaaggccaagatcatcggcgccgacatccagaacacgaccttcatcatcgacgggcccgacaccccggagtgccccgacgaccagcgcgcgtggaacatctgggaggtcgaggactacggcttcgggatcttcaccacgaacatctggctgaagctccgggactcctacacccagatgtgcgaccaccgcctgatgagcgccgccatcaaggactccaaggccgtgcacgccgacatgggctactggatcgagagcgagaagaacgagacctggaagctggcgcgggcctccttcatcgaggtgaagacctgcacgtggcccaagagccacaccctctggtccaacggcgtcctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtggtggtcgacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtccggagcatggtgtccgccggcagcggcgaggtggacagcttctccctggggatcctgtgcgtcagcatcatgatcgaggaggtgatgcgctcccggtggagccgcaagatgctcatgaccggcacgctggccgtgttcctgctcctgatcatggggcagctgacctggaacgacctcatccgcctgtgcatcatggtcggcgcgaacgcctccgaccggatggggatgggcaccacctacctggccctcatggccacgttcaagatgcgcccgatgttcgccgtggggctgctgttccggcgcctcaccagccgggaggtgctgctgctcaccatcgggctgtccctggtcgccagcgtggagctccccaactccctggaggagctgggcgacgggctcgccatgggcatcatgatgctgaagctgctcaccgagttccagccccaccagctgtggacgaccctgctcagcctgaccttcatcaagaccacgctgtccctcgactacgcctggaagaccaccgccatggtcctgagcatcgtgtccctgttccccctctgcctgagcaccacgtcccagaagaccacctggctgccggtgctcctgggcagcttcgggtgcaagcccctgaccatgttcctcatcaccgagaacaagatctggggccgcaagtcctggcccctgaacgaggggatcatggcggtcggcatcgtgagcatgctgctctccagcctgctgaagaacgacgtgcccctcgccgggccgctgatcgccggcggcatgctgatcgcctgctacgtcatcagcgggtccagcgccgacctctccctggagaaggcggccgaggtgagctgggagcaggaggccgagcactccggcacgagccacaacatcctggtggaggtccaggacgacgggaccatgaagatcaaggacgaggagcgggacgacaccctcaccatcctgctgaaggccacgctcctggccgtgtccggcgtgtaccccatgagcatccccgcgaccctgttcgtctggtacttctggcagaagaagaagcagcgctccggggtgctctgggacacccccagcccgcccgaggtggagcgggccgtcctggacgacggcatctaccgcatcctgcagcggggcctgctcgggcgctcccaggtgggcgtgggggtcttccaggacggcgtgttccacaccatgtggcacgtgacgcgcggggccgtcctgatgtaccagggcaagcgcctggagcccagctgggcctccgtgaagaaggacctcatcagctacggcgggggctggcggttccaggggtcctggaacaccggcgaggaggtgcaggtcatcgccgtggagcccgggaagaacccgaagaacgtgcagaccacccccggcacgttcaagacccccgagggcgaggtcggggcgatcgccctggacttcaagcccggcaccagcgggtccccgatcgtgaaccgcgagggcaagatcgtgggcctgtacgggaacggcgtcgtgaccacgagcgggacctacgtgtccgccatcgcccaggccaaggcgagccaggagggccccctccccgagatcgaggacgaggtcttcaagaagcggaacctgaccatcatggacctgcacccggggagcggcaagacccgccggtacctccccgccatcgtgcgcgaggccatcaagcggaagctgcgcacgctgatcctcgcccccacccgcgtggtcgcgtccgagatggccgaggccctgaagggcatgcccatccggtaccagaccaccgccgtcaagagcgagcacacggggcgcgagatcgtggacctgatgtgccacgccaccttcaccatgcggctcctgtccccggtccgcgtgcccaactacaacatgatcatcatggacgaggcgcacttcaccgaccccgccagcatcgccgcccggggctacatctccacgcgcgtggggatgggcgaggccgcggccatcttcatgaccgccacgccgcccgggagcgtcgaggccttcccccagtccaacgccgtgatccaggacgaggagcgggacatccccgagcgcagctggaactccggctacgactggatcaccgacttccccggcaagacggtgtggttcgtccccagcatcaagtccgggaacgacatcgcgaactgcctgcggaagaacggcaagcgcgtgatccagctcagccggaagaccttcgacaccgagtaccagaagaccaagaacaacgactgggactacgtggtcacgaccgacatctccgagatgggggccaacttccgcgccgaccgggtgatcgacccccgccggtgcctgaagcccgtgatcctgaaggacggccccgagcgcgtcatcctcgccgggccgatgcccgtgaccgtcgcgagcgccgcccagcggcgcggccggatcggccgcaaccagaacaaggagggggaccagtacgtgtacatgggccagcccctgaacaacgacgaggaccacgcccactggaccgaggccaagatgctgctcgacaacatcaacacgcccgaggggatcatcccggcgctgttcgagcccgagcgcgagaagtccgccgccatcgacggcgagtaccggctgcgcggggaggcccggaagaccttcgtggagctcatgcgccggggcgacctgcccgtctggctgagctacaaggtggcctccgagggcttccagtacagcgaccgccggtggtgcttcgacggggagcgcaacaaccaggtgctcgaggagaacatggacgtcgagatctggaccaaggagggcgagcggaagaagctgcgcccccggtggctggacgcgcgcacctactccgacccgctcgccctgcgggagttcaaggagttcgccgccgggcgccggagcgtgagcggcgacctgatcctcgagatcggcaagctgccccagcacctgaccctccgcgcccagaacgcgctggacaacctggtgatgctccacaactccgagcagggcgggaaggcctaccggcacgccatggaggagctgcccgacacgatcgagaccctgatgctcctggccctgatcgcggtcctcaccgggggcgtgaccctgttcttcctgagcgggaagggcctcggcaagacgtccatcgggctgctgtgcgtgaccgccagctccgccctcctgtggatggccagcgtcgagccccactggatcgccgcgtccatcatcctggagttcttcctcatggtgctgctgatcccggagcccgaccgccagcggacgccccaggacaaccagctcgcctacgtggtcatcggcctgctgttcatgatcctcaccgtggccgccaacgagatggggctgctggagacgaccaagaaggacctcggcatcgggcacgtggccgcggagaaccaccagcacgccaccatgctggacgtcgacctgcgcccggccagcgcctggaccctctacgccgtggcgacgaccgtgatcacccccatgatgcggcacaccatcgagaacacgaccgccaacatctccctgaccgccatcgccaaccaggccgcgatcctgatgggcctcgacaagggctggcccatcagcaagatggacatcggggtccccctgctggccctcggctgctactcccaggtgaacccgctgaccctgacggccgccgtgctcatgctggtcgcgcactacgccatcatcgggcccggcctgcaggccaaggccacccgcgaggcccagaagcgcaccgcggccgggatcatgaagaaccccaccgtggacggcatcgtggccatcgacctcgaccccgtcgtgtacgacgccaagttcgagaagcagctgggccagatcatgctgctcatcctgtgcacgagccagatcctgctcatgcggaccacctgggccctgtgcgagtccatcaccctggcgacggggccgctcaccaccctgtgggagggcagccccgggaagttctggaacaccacgatcgccgtgtccatggccaacatcttccgcggcagctacctggccggcgccgggctcgcgttctccctgatgaagtccctgggcgggggccggcgcgggaccggcgcccagggcgagaccctcggggagaagtggaagcggcagctgaaccagctgtccaagagcgagttcaacacctacaagcgcagcggcatcatggaggtcgaccggtccgaggccaaggaggggctcaagcgcggcgagacgaccaagcacgccgtgagccgggggaccgcgaagctgcgctggttcgtggagcggaacctggtcaagcccgagggcaaggtgatcgacctgggctgcgggcgcggcgggtggtcctactactgcgccggcctcaagaaggtgaccgaggtcaaggggtacaccaagggcggccccgggcacgaggagccgatccccatggccacgtacggctggaacctggtgaagctgcacagcgggaaggacgtgttcttcatgccgcccgagaagtgcgacaccctcctgtgcgacatcggcgagtccagcccgaaccccaccatcgaggaggggcggaccctgcgcgtcctcaagatggtggagccctggctgcggggcaaccagttctgcatcaagatcctgaacccctacatgccgtccgtggtcgagacgctcgagcagatgcagcgcaagcacggcgggatgctggtgcggaaccccctgagccgcaactccacccacgagatgtactgggtgagctgcggcaccgggaacatcgtctccgccgtgaacatgaccagccggatgctcctgaaccgcttcacgatggcccaccgcaagcccacctacgagcgggacgtggacctgggcgcgggcacccgccacgtcgccgtggagcccgaggtggccaacctcgacatcatcgggcagcggatcgagaacatcaagaacgagcacaagtccacctggcactacgacgaggacaacccgtacaagacgtgggcctaccacggcagctacgaggtcaagccctccgggagcgcctccagcatggtgaacggcgtcgtgcgcctgctgaccaagccctgggacgtgatccccatggtcacccagatcgcgatgaccgacacgaccccgttcgggcagcagcgggtgttcaaggagaaggtggacacccgcacgccccgggccaagcgcggcacgacccagatcatggaggtcaccgccaagtggctctggggcttcctgtcccggaacaagaagccccgcatctgcacccgggaggagttcacgcgcaaggtgcggagcaacgccgccatcggggcggtgttcgtcgacgagaaccagtggaacagcgccaaggaggccgtggaggacgagcgcttctgggacctggtgcaccgggagcgcgagctccacaagcagggcaagtgcgcgacctgcgtctacaacatgatggggaagcgggagaagaagctgggcgagttcgggaaggcgaagggctcccgcgccatctggtacatgtggctgggcgcccggttcctcgagttcgaggccctggggttcatgaacgaggaccactggttcagccgcgagaactccctgagcggcgtggagggggagggcctccacaagctggggtacatcctgcgggacatctccaagatcccgggcggcaacatgtacgccgacgacaccgcggggtgggacacccgcatcacggaggacgacctccagaacgaggccaagatcaccgacatcatggagcccgagcacgccctgctggccaccagcatcttcaagctcacctaccagaacaaggtggtccgcgtgcagcggcccgccaagaacggcacggtgatggacgtcatctcccgccgggaccagcgcgggagcggccaggtgggcacctacgggctgaacaccttcaccaacatggaggtgcagctgatccggcagatggagtccgagggcatcttcctccccagcgagctggagacgccgaacctggcggagcgcgtcctcgactggctggagaagcacggggccgagcggctgaagcgcatggccatctccggcgacgactgcgtggtgaagcccatcgacgaccggttcgccaccgccctcaccgcgctgaacgacatggggaagatccgcaaggacatcccccagtgggagcccagcaagggctggaacgactggcagcaggtcccgttctgctcccaccacttccaccagctgatcatgaaggacggccgggagatcgtggtgccctgccgcaaccaggacgagctcgtcgggcgggcccgcgtgagccagggcgccgggtggtccctgcgggagaccgcctgcctgggcaagagctacgcccagatgtggcagctcatgtacttccaccgccgggacctgcgcctggcggccaacgccatctgctccgccgtgcccgtcgactgggtgcccaccagccggacgacctggagcatccacgcgcaccaccagtggatgaccaccgaggacatgctctccgtgtggaaccgcgtctggatcgaggagaacccgtggatggaggacaagacgcacgtgagctcctgggaggaggtgccctacctggggaagcgcgaggaccagtggtgcggcagcctgatcggcctcaccgcccgggccacctgggccaccaacatccaggtcgccatcaaccaggtgcgccggctgatcgggaacgagaactacctggactacatgacgtccatgaagcgcttcaagaacgagagcgacaccgagggcgcgctctggtga

SEQ ID NO: 8269 - RNA, 9879 nt, synthetic construct
  misc_feature 1..9879: note = derived and/or modified CDS sequence (opt1) from DENV-1__GU056033__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgtgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacgcgcaccgagacctggatgagcagcgagggcgcgtggaagcagatccagcgggtggagacctgggccctgcgccaccccgggttcacggtgatcgccctgttcctcgcccacgcgatcggcaccagcatcacccagaaggggatcatcttcatcctgctgatgctcgtcaccccctccatggccatgcggtgcgtgggcatcggcaaccgcgacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccggaagctgtgcatcgaggcgaagatcagcaacaccaccacggactcccgctgcccgacccagggcgaggccaccctggtcgaggagcaggacgccaacttcgtgtgccggcgcaccttcgtggaccggggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccggcaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccgcctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttctccacccaggacgagaagggggtcacccagaacggccggctcatcacggccaacccgatcgtgaccgacaaggagaagcccgtgaacatcgagaccgagccgcccttcggggagagctacatcgtcgtgggcgccggcgagaaggccctgaagctgtcctggttcaagaaggggagctccatcggcaagatgttcgaggcgaccgcccgcggggcccggcgcatggccatcctcggcgacacggcctgggacttcgggagcatcggcggcgtgttcacctccgtcgggaagctggtgcaccaggtgttcggcaccgcgtacggggtcctgttcagcggcgtgtcctggaccatgaagatcgggatcggcatcctcctgacgtggctgggcctcaacagccgctccaccagcctgtccatgacctgcatcgccgtggggatggtcaccctgtacctcggcgtgatggtgcaggccgacagcgggtgcgtcatcaactggaagggccgggagctgaagtgcgggtccggcatcttcgtgacgaacgaggtgcacacctggaccgagcagtacaagttccaggccgacagcccgaagcgcctgagcgccgcgatcggcaaggcctgggaggagggggtctgcggcatccggtccgccacccgcctcgagaacatcatgtggaagcagatcagcaacgagctgaaccacatcctgctcgagaacgacatgaagttcaccgtggtggtcggggacgtgaacggcatcctggcccaggggaagaagatgatccggccccagcccatggagcacaagtactcctggaagtcctggggcaaggccaagatcatcggcgcggacatccagaacacgaccttcatcatcgacgggcccgacaccccggagtgccccgacgaccagcgcgcctggaacatctgggaggtggaggactacggcttcgggatcttcaccacgaacatctggctgaagctccgggactcctacacccagatgtgcgaccaccgcctgatgagcgccgccatcaaggactccaaggcggtccacgccgacatgggctactggatcgagagcgagaagaacgagacctggaagctggccaaggcctccttcatcgaggtgaagacctgcatctggcccaagagccacacgctctggtccaacggcgtgctggagagcgagatgatcatccccaagatctacgggggcccgatctcccagcacaactaccggcccgggtacttcacccagaccgccggcccctggcacctggggaagctcgagctggacttcgacctgtgcgagggcaccacggtcgtggtggacgagcactgcggcaaccgcgggccgagcctccggaccaccaccgtcacgggcaagatcatccacgagtggtgctgccgctcctgcaccctgccgcccctgcggttccgcggggaggacggctgctggtacgggatggagatccggcccgtgaaggagaaggaggagaacctcgtgcgcagcatggtctccgcgggcagcggcgaggtggacagcttctccctggggatcctgtgcgtgagcatcatgatcgaggaggtcatgcggtcccgctggagccggaagatgctcatgaccggcaccctggccgtgttcctgctcctgatcatggggcagctgacgtggaacgacctcatccgcctgtgcatcatggtgggcgccaacgcctccgaccgcatggggatgggcaccacctacctggccctcatggccaccttcaagatgcggccgatgttcgccgtcgggctgctgttccgccggctcacgagccgcgaggtgctgctgctcaccatcgggctgtccctggtcgccagcgtggagctccccaactccctggaggagctgggcgacgggctcgccatgggcatcatgatgctgaagctgctcaccgagttccagccccaccagctgtggaccacgctgctcagcctgaccttcatcaagaccaccctgtccctcgactacgcctggaagacgaccgcgatggccctgagcatcgtgtccctgttccccctctgcctgagcaccacctcccagaagacgacctggctgccggtcctcctgggcagcttcgggtgcaagcccctgaccatgttcctcatcaccgagaacaagatctggggccggaagtcctggcccctgaacgaggggatcatggccatcggcatcgtgagcatcctgctctccagcctgctgaagaacgacgtgcccctcgccgggccgctgatcgcgggcggcatgctgatcgcctgctacgtcatcagcgggtccagcgccgacctctccctggagaaggccgccgaggtgagctgggagcaggaggcggagcactccggcaccagccacaacatcctggtggaggtccaggacgacgggacgatgaagatcaaggacgaggagcgcgacgacaccctcaccatcctgctgaaggccaccctcctggccgtgtccggcgtgtaccccatgagcatccccgccacgctgttcgtctggtacttctggcagaagaagaagcagcggtccggggtgctctgggacacccccagcccgcccgaggtggagcgcgccgtcctggacgacggcatctaccggatctcccagcgcggcctgctggggcggagccaggtgggcgtgggggtcttccaggacggcgtgttccacaccatgtggcacgtgacccgcggggcggtcctcatgtaccagggcaagcggctggagccctcctgggccagcgtgaagaaggacctgatctcctacggcgggggctggcgcttccaggggagctggaacacgggcgaggaggtgcaggtcatcgccgtggagcccgggaagaacccgaagaacgtgcagaccacccccggcaccttcaagacgcccgagggcgaggtcggggccatcgccctcgacttcaagcccggcacctccgggagcccgatcgtgaaccgggagggcaagatcgtgggcctgtacgggaacggcgtcgtgaccacctccgggacgtacgtgagcgcgatcgcccaggccaaggccagccaggagggccccctgcccgagatcgaggacgaggtcttcaagaagcgcaacctcaccatcatggacctgcacccggggtccggcaagacccggcgctacctgcccgccatcgtgcgggaggcgatcaagcgcaagctccggaccctgatcctggcccccacgcgcgtggtcgccagcgagatggccgaggcgctcaagggcatgcccatccgctaccagaccaccgccgtgaagtccgagcacaccgggcgggagatcgtggacctgatgtgccacgccacgttcaccatgcgcctgctcagcccggtccgggtgcccaactacaacatgatcatcatggacgaggcccacttcaccgaccccgcctccatcgcggcccgcggctacatcagcacccgggtggggatgggcgaggccgccgccatcttcatgacggcgacgccgcccgggtccgtcgaggccttcccccagagcaacgccgtgatccaggacgaggagcgcgacatccccgagcggtcctggaacagcggctacgactggatcaccgacttccccggcaagaccgtgtggttcgtcccctccatcaagagcgggaacgacatcgccaactgcctgcgcaagaacggcaagcgggtgatccagctgtcccgcaagacgttcgacaccgagtaccagaagaccaagaacaacgactgggactacgtggtcaccacggacatcagcgagatgggggccaacttccgggcggaccgcgtgatcgacccccggcgctgcctcaagcccgtgatcctgaaggacggccccgagcgggtcatcctggccgggccgatgcccgtgaccgtcgcctccgccgcgcagcgccggggccgcatcggccggaaccagaacaaggagggggaccagtacgtgtacatgggccagcccctcaacaacgacgaggaccacgcccactggaccgaggccaagatgctgctggacaacatcaacacccccgaggggatcatcccggccctcttcgagcccgagcgcgagaagtccgccgcgatcgacggcgagtaccgcctgcgcggggaggcccgcaagacgttcgtggagctgatgcggcgcggcgacctccccgtctggctgtcctacaaggtggccagcgagggcttccagtactccgaccggcgctggtgcttcgacggggagcggaacaaccaggtgctggaggagaacatggacgtcgagatctggaccaaggagggcgagcgcaagaagctccggccccgctggctggacgcccggacctacagcgacccgctggccctccgcgagttcaaggagttcgcggccgggcggcgcagcgtgtccggcgacctgatcctggagatcggcaagctcccccagcacctgaccctgcgggcccagaacgccctcgacaacctggtgatgctgcacaacagcgagcagggcgggaaggcctaccgccacgcgatggaggagctccccgacaccatcgagacgctgatgctgctcgccctgatcgccgtcctgaccgggggcgtgaccctcttcttcctgtccgggaagggcctgggcaagaccagcatcgggctcctgtgcgtgacggcctccagcgcgctgctctggatggcctccgtcgagccccactggatcgccgccagcatcatcctggagttcttcctgatggtgctcctgatcccggagcccgaccggcagcgcacgccccaggacaaccagctggcctacgtggtcatcggcctcctgttcatgatcctgaccgtggcggccaacgagatggggctcctggagaccacgaagaaggacctgggcatcgggcacgtggccgccgagtcccaccagcacgccaccatgctcgacgtcgacctgcggccggcgagcgcctggaccctgtacgccgtggccaccacggtgatcacccccatgatgcgccacaccatcgagaacaccacggccaacatctccctcaccgcgatcgccaaccaggccgccatcctgatgggcctggacaagggctggcccatcagcaagatggacatcggggtccccctcctggccctgggctgctactcccaggtgaacccgctcaccctgaccgcggccgtgctgatgctcgtcgcccactacgccatcatcgggcccggcctgcaggcgaaggccacgcgggaggcccagaagcgcaccgccgccgggatcatgaagaaccccaccgtggacggcatcgtggcgatcgacctggaccccgtcgtgtacgacgccaagttcgagaagcagctcggccagatcatgctgctgatcctctgcaccagccagatcctgctgatgcgcacgacctgggccctctgcgagtccatcaccctggccaccgggccgctgacgaccctctgggagggcagccccgggaagttctggaacaccaccatcgccgtgtccatggcgaacatcttccggggcagctacctggccggcgccgggctggccttctccctcatgaagtccctgggcgggggccgccgggggacgggcgcccagggcgagaccctgggggagaagtggaagcgccagctcaaccagctgagcaagaccgagttcaacacctacaagcggtccggcatcatggaggtcgaccgcagcgaggcgaaggaggggctgaagcggggcgagacgaccaagcacgccgtgtcccgcgggaccgccaagctccggtggttcgtggagcgcaacctggtcaagcccgagggcaaggtgatcgacctgggctgcgggcggggcgggtggagctactactgcgccggcctgaagaaggtgaccgaggtcaaggggtacaccaagggcggcctcgggcacgaggagcccatcccgatggcgacgtacggctggaacctggtgaagctgcactccgggaaggacgtgttcttcatgccgcccgagaagtgcgacaccctcctgtgcgacatcggcgagagctcccccaacccgaccatcgaggaggggcgcaccctgcgggtcctcaagatggtggagccctggctgcgcggcaaccagttctgcatcaagatcctgaacccctacatgcccagcgtggtcgagacgctcgagcagatgcagcggaagcacggcgggatgctggtgcgcaacccgctgtcccggaacagcacccacgagatgtactgggtgtcctgcggcaccgggaacatcgtcagcgccgtgaacatgacctcccgcatgctcctgaaccggttcacgatggcccaccgcaagcccacctacgagcgcgacgtggacctgggcgccggcacccggcacgtcgccgtggagcccgaggtggcgaacctcgacatcatcgggcagcgcatcgagaacatcaagaacgagcacaagagcacctggcactacgacgaggacaacccctacaagacgtgggcctaccacggctcctacgaggtcaagccgagcgggtccgccagctccatggtgaacggcgtcgtgaagctgctgaccaagccctgggacgtgatccccatggtcacccagatcgccatgaccgacacgacccccttcgggcagcagcgggtgttcaaggagaaggtggacacccgcaccccgcgggccaagcgcggcacgacccagatcatggaggtcaccgcgaagtggctctggggcttcctgagccggaacaagaagccccgcatctgcacccgggaggagttcacgcgcaaggtgcggagcaacgccgccatcggggccgtgttcgtcgacgagaaccagtggaactccgccaaggaggcggtggaggacgagcgcttctggaacctggtgcaccgggagcgcgagctccacaagcagggcaagtgcgcgacctgcgtctacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtggagggggagggcctccacaagctggggtacatcctgcgggacatcagcaagatccccggcggcaacatgtacgccgacgacaccgccgggtgggacacccgcatcacggaggacgacctccagaacgaggccaagatcaccgacatcatggagccggagcacgcgctgctggccacctccatcttcaagctcacctaccagaacaaggtggtccgggtgcagcgccccgccaagaacggcacggtgatggacgtcatcagccgccgggaccagcgcgggtccggccaggtgggcacctacgggctgaacaccttcaccaacatggaggtgcagctgatccggcagatggagagcgagggcatcttcctcccctccgagctggagacgcccaacctggccgagcgcgtcctcgactggctggagaagcacggggccgagcggctgaagcgcatggcgatcagcggcgacgactgcgtggtgaagccgatcgacgaccggttcgccaccgccctcaccgccctgaacgacatggggaaggtccgcaaggacatcccccagtgggagccctccaagggctggaacgactggcagcaggtccccttctgcagccaccacttccaccagctgatcatgaaggacggccgggagatcgtggtcccgtgccgcaaccaggacgagctcgtggggcgggcccgcgtgtcccagggcgcggggtggagcctgcgggagaccgcctgcctgggcaagtcctacgcccagatgtggcagctcatgtacttccaccgccgggacctgcgcctggccgccaacgcgatctgcagcgccgtccccgtggactgggtgcccaccagccggacgacctggtccatccacgcccaccaccagtggatgaccaccgaggacatgctcagcgtctggaaccgcgtgtggatcgaggagaacccctggatggaggacaagacgcacgtgtccagctgggaggaggtcccgtacctggggaagcgggaggaccagtggtgcggctccctgatcggcctcaccgcccgcgcgacctgggccaccaacatccaggtggccatcaaccaggtgcgccggctgatcgggaacgagaactacctggactacatgacgagcatgaagcgcttcaagaacgagtccgaccccgagggcgccctctggtga

SEQ ID NO: 8270 - RNA, 9879 nt, synthetic construct
  misc_feature 1..9879: note = derived and/or modified CDS sequence (opt1) from DENV-1__GU131833__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttcctcacccaggacgagaagggggtgacgcagaacggccggctgatcaccgccaacccgatcgtcaccgacaaggagaagcccgtgaacatcgagaccgagccgcccttcggggagtcctacatcgtggtcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccaggtgttcggcaccgcctacggggtcctgttctccggcgtcagctggacgatgaagatcgggatcggcatcctgctgacctggctcggcctgaactcccgcagcacctccctgagcatgacctgcatcgccgtggggatggtgacgctctacctgggcgtcatggtgcaggccgactccgggtgcgtgatcaactggaagggccgggagctgaagtgcgggagcggcatcttcgtcaccaacgaggtgcacacctggaccgagcagtacaagttccaggccgactccccgaagcgcctcagcgcggccatcggcaaggcctgggaggagggggtgtgcggcatccggagcgccacccgcctggagaacatcatgtggaagcagatctccaacgagctgaaccacatcctcctggagaacgacatgaagttcacggtcgtggtgggggacgccaacggcatcctggcgcaggggaagaagatgatccggccccagcccatggagcacaagtacagctggaagtcctggggcaaggccaagatcatcggcgccgacatccagaacaccaccttcatcatcgacgggcccgacaccccggagtgccccgacgaccagcgcgcctggaacatctgggaggtcgaggactacggcttcgggatcttcacgaccaacatctggctcaagctgcgggacagctacacccagatgtgcgaccaccgcctgatgtccgcggccatcaaggacagcaaggccgtgcacgccgacatgggctactggatcgagtccgagaagaacgagacctggaagctcgcccgggcgagcttcatcgaggtgaagacgtgcacctggcccaagtcccacaccctgtggagcaacggcgtcctggagtccgagatgatcatccccaagatctacgggggcccgatcagccagcacaactaccgccccgggtacttcacccagacggccggcccctggcacctcgggaagctggagctggacttcgacctctgcgagggcaccaccgtggtggtcgacgagcactgcggcaaccgggggccgtccctgcgcaccacgaccgtgaccggcaagatcatccacgagtggtgctgccggagctgcaccctgccgcccctccgcttccgcggggaggacggctgctggtacgggatggagatccgccccgtgaaggagaaggaggagaacctggtccggtccatggtgagcgccggctccggcgaggtggacagcttcagcctggggatcctctgcgtctccatcatgatcgaggaggtgatgcgcagccggtggtcccgcaagatgctgatgacgggcaccctggccgtgttcctcctgctgatcatggggcagctcacctggaacgacctgatccgcctgtgcatcatggtcggcgccaacgcgagcgaccggatggggatgggcaccacgtacctcgccctgatggccaccttcaagatgcgcccgatgttcgccgtggggctcctcttccggcgcctgacctcccgggaggtgctgctcctgaccatcgggctgagcctcgtcgcctccgtggagctgcccaacagcctggaggagctcggcgacgggctggcgatgggcatcatgatgctgaagctcctgacggagttccagccccaccagctgtggaccaccctcctgtccctgaccttcatcaagacgaccctcagcctggactacgcctggaagaccaccgccatggccctgtccatcgtcagcctcttccccctgtgcctgtccacgaccagccagaagaccacctggctcccggtgctgctgggctccttcgggtgcaagcccctcaccatgttcctgatcacggagaacaagatctggggccgcaagagctggcccctgaacgaggggatcatggcgatcggcatcgtgtccatcctcctgagctccctgctcaagaacgacgtccccctggccgggccgctgatcgccggcggcatgctcatcgcctgctacgtgatcagcgggagctccgccgacctgagcctggagaaggcggccgaggtgtcctgggagcaggaggccgagcacagcggcacctcccacaacatcctcgtcgaggtgcaggacgacgggaccatgaagatcaaggacgaggagaaggacgacaccctgacgatcctgctcaaggccaccctgctggccgtgagcggcgtctaccccatgtccatccccgcgaccctcttcgtgtggtacttctggcagaagaagaagcagcggagcggggtgctgtgggacaccccctccccgcccgaggtcgagcgcgccgtgctggacgacggcatctaccggatcctgcagcgcggcctcctggggcggagccaggtgggcgtcggggtgttccagaacggcgtgttccacacgatgtggcacgtcacccgcggggccgtgctgatgtaccagggcaagcggctcgagccctcctgggccagcgtgaagaaggacctgatctcctacggcgggggctggcgcttccaggggagctggaacaccggcgaggaggtccaggtgatcgccgtggagcccgggaagaacccgaagaacgtccagaccacgcccggcaccttcaagacccccgagggcgaggtgggggcgatcgccctggacttcaagcccggcacctccgggagcccgatcgtgaaccgggagggcaagatcgtcggcctctacgggaacggcgtggtgacgacctccgggacctacgtcagcgccatcgcccaggccaaggcgtcccaggagggccccctgcccgagatcgaggacgaggtgttcaagaagcgcaacctgaccatcatggacctccacccggggagcggcaagacgcggcgctacctgcccgccatcgtgcgggaggccatcaagcgcaagctgcggaccctcatcctggcccccacccgcgtcgtggcgagcgagatggccgaggccctgaagggcatgcccatccgctaccagaccacggccgtgaagtccgagcacaccgggcgggagatcgtcgacctcatgtgccacgccaccttcaccatgcgcctgctgagcccggtgcgggtgcccaactacaacatgatcatcatggacgaggcgcacttcacggaccccgcctccatcgccgcccgcggctacatcagcacccgggtcgggatgggcgaggccgcggccatcttcatgaccgccacgccgcccgggtccgtggaggccttcccccagagcaacgccgtgatccaggacgaggagcgcgacatccccgagcggtcctggaacagcggctacgactggatcacggacttccccggcaagaccgtctggttcgtgccctccatcaagagcgggaacgacatcgcgaactgcctccgcaagaacggcaagcgggtgatccagctgtcccgcaagaccttcgacaccgagtaccagaagacgaagaacaacgactgggactacgtcgtgaccaccgacatcagcgagatgggggccaacttccgggccgaccgcgtgatcgacccccggcgctgcctgaagcccgtcatcctcaaggacggccccgagcgggtgatcctggccgggccgatgcccgtgaccgtcgcgtccgccgcccagcgccggggccgcatcggccggaaccagaacaaggagggggaccagtacgtgtacatgggccagcccctgaacaacgacgaggaccacgcccactggacggaggccaagatgctcctggacaacatcaacacccccgaggggatcatcccggcgctgttcgagcccgagcgcgagaagtccgccgccatcgacggcgagtaccgcctccgcggggaggcccgcaagaccttcgtcgagctgatgcggcgcggcgacctgcccgtgtggctctcctacaaggtggccagcgagggcttccagtactccgaccggcgctggtgcttcgacggggagcggaacaaccaggtcctggaggagaacatggacgtggagatctggaccaaggagggcgagcgcaagaagctgcggccccgctggctcgacgcgcggacctacagcgacccgctggccctgcgcgagttcaaggagttcgccgccgggcggcgctccgtgagcggcgacctcatcctggagatcggcaagctgccccagcacctcacgctgcgggcccagaacgcgctggacaacctcgtcatgctgcacaacagcgagcagggcgggaaggcctaccgccacgccatggaggagctgcccgacaccatcgagaccctcatgctgctggccctcatcgcggtgctgaccgggggcgtgacgctgttcttcctctccgggaagggcctgggcaagaccagcatcgggctgctctgcgtcaccgcctccagcgccctgctgtggatggcctccgtggagccccactggatcgccgcgagcatcatcctcgagttcttcctgatggtgctgctcatcccggagcccgaccggcagcgcacgccccaggacaaccagctggcctacgtcgtgatcggcctcctcttcatgatcctgacggtggccgccaacgagatggggctgctcgagaccaccaagaaggacctgggcatcgggcacgtcgccgcggagaaccaccagcacgccaccatgctggacgtggacctccggccggcctccgcctggacgctgtacgccgtggcgaccaccgtcatcacccccatgatgcgccacacgatcgagaacaccaccgccaacatcagcctgaccgccatcgccaaccaggccgcgatcctcatgggcctggacaagggctggcccatctccaagatggacatcggggtgcccctgctcgccctgggctgctacagccaggtgaacccgctgacgctcaccgccgccgtcctgatgctggtggcgcactacgccatcatcgggcccggcctccaggccaaggccacccgggaggcccagaagcgcaccgcggccgggatcatgaagaaccccacggtggacggcatcgtcgccatcgacctggaccccgtggtgtacgacgccaagttcgagaagcagctgggccagatcatgctcctgatcctgtgcacctcccagatcctcctgatgcgcaccacctgggccctgtgcgagagcatcacgctcgcgaccgggccgctgaccaccctgtgggagggctcccccgggaagttctggaacacgaccatcgccgtcagcatggccaacatcttccggggctcctacctcgccggcgccgggctggcgttcagcctgatgaagtccctcggcgggggccgccgggggaccggcgcccagggcgagaccctgggggagaagtggaagcgccagctgaaccagctcagcaagtccgagttcaacacgtacaagcggagcggcatcatggaggtggaccgcagcgaggccaaggaggggctgaagcggggcgagaccaccaagcacgccgtgtcccgcgggaccgcgaagctgcggtggttcgtcgagcgcaacctggtgaagcccgagggcaaggtgatcgacctcggctgcgggcggggcgggtggagctactactgcgccggcctgaagaaggtcaccgaggtgaaggggtacacgaagggcggccccgggcacgaggagccgatccccatggccacctacggctggaacctggtgaagctccactccgggaaggacgtcttcttcatgccgcccgagaagtgcgacaccctgctgtgcgacatcggcgagagctccccgaaccccaccatcgaggaggggcgcacgctccgggtgctgaagatggtggagccctggctgcgcggcaaccagttctgcatcaagatcctcaacccctacatgccgagcgtcgtggagaccctggagcagatgcagcggaagcacggcgggatgctggtgcgcaaccccctctcccggaacagcacccacgagatgtactgggtctcctgcggcaccgggaacatcgtgagcgccgtgaacatgacgtcccgcatgctgctgaaccggttcaccatggcccaccgcaagcccacctacgagcgcgacgtcgacctcggcgcgggcacccggcacgtggccgtggagcccgaggtcgccaacctggacatcatcgggcagcgcatcgagaacatcaagaacgagcacaagagcacgtggcactacgacgaggacaacccgtacaagacctgggcctaccacggctcctacgaggtgaagcccagcgggtccgccagctccatggtgaacggcgtcgtgcggctgctcaccaagccctgggacgtcatccccatggtgacccagatcgcgatgacggacaccaccccgttcgggcagcagcgcgtgttcaaggagaaggtcgacacccggacgccccgcgccaagcggggcaccacccagatcatggaggtgaccgcccgctggctgtggggcttcctgagccggaacaagaagccccgcatctgcacgcgggaggagttcacccgcaaggtgcggtccaacgccgccatcggggcggtcttcgtggacgagaaccagtggaacagcgccaaggaggccgtggaggacgagcgcttctgggacctcgtccaccgggagcgcgagctgcacaagcagggcaagtgcgcgacctgcgtgtacaacatgatggggaagcgggagaagaagctgggcgagttcgggaaggcgaagggcagccgcgccatctggtacatgtggctcggcgcccggttcctggagttcgaggccctggggttcatcaacgaggaccactggttctcccgcgagaacagcctctccggcgtggagggggagggcctgcacaagctggggtacatcctccgggacatcagcaagatcccgggcggcaacatgtacgccgacgacaccgcggggtgggacacgcgcatcaccgaggacgacctgcagaacgaggccaagatcaccgacatcatggagcccgagcacgccctgctcgccacctccatcttcaagctgacgtaccagaacaaggtcgtgcgcgtgcagcggcccgccaagaacggcaccgtcatggacgtgatcagccgccgggaccagcgcgggtccggccaggtgggcacctacgggctgaacaccttcacgaacatggaggtccagctcatccggcagatggagagcgagggcatcttcctgccctccgagctggagaccccgaacctcgcggagcgcgtgctggactggctggagaagcacggggccgagcggctcaagcgcatggccatcagcggcgacgactgcgtggtcaagcccatcgacgaccggttcgccaccgccctgaccgcgctgaacgacatggggaaggtgcgcaaggacatcccccagtgggagccctccaagggctggaacgactggcagcaggtcccgttctgcagccaccacttccaccagctcatcatgaaggacggccgggagatcgtcgtgccctgccgcaaccaggacgagctggtggggcgggcccgcgtctcccagggcgccgggtggagcctgcgggagaccgcctgcctcggcaagtcctacgcccagatgtggcagctgatgtacttccaccgccgggacctgcgcctcgcggccaacgccatctgcagcgccgtgcccgtggactgggtccccacgtcccggaccacctggagcatccacgcgcaccaccagtggatgaccacggaggacatgctgagcgtgtggaaccgcgtgtggatcgaggagaacccgtggatggaggacaagacccacgtctccagctgggaggaggtgccctacctggggaagcgcgaggaccagtggtgcggctccctcatcggcctgaccgcccgggccacctgggccacgaacatccaggtggccatcaaccaggtccgccggctgatcgggaacgagaactacctcgactacatggcgagcatgaagcgcttcaagaacgagtccgaccccgagggcgccctgtggtga

SEQ ID NO: 8271 - RNA, 9879 nt, synthetic construct
  misc_feature 1..9879: note = derived and/or modified CDS sequence (opt1) from DENV-1__GU131834__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaagaccctgaagctgtcctggttcaagaaggggagctccatcggcaagatgttcgaggcgacggcccgcggggcccggcgcatggccatcctcggcgacaccgcctgggacttcgggagcatcggcggcgtgttcacctccgtggggaagctggtccaccaggtgttcggcaccgcgtacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgccgcgatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgccaacggcatcctggcccaggggaagaagatgatccggccccagcccatggagcacaagtactcctggaagtcctggggcaaggcgaagatcatcggcgccgacatccagaacaccaccttcatcatcgacgggcccgacaccccggagtgccccgacggccagcgcgcctggaacatctgggaggtcgaggactacgggttcggcatcttcacgaccaacatctggctgaagctccgggactcctacacccagatgtgcgaccaccgcctgatgagcgccgcgatcaaggactccaaggccgtgcacgccgacatgggctactggatcgagagcgagaagaacgagacctggaagctggcccgggcctccttcatcgaggtgaagacgtgcacctggcccaagagccacaccctctggtccaacggggtcctggagagcgagatgatcatccccaagatctacggcgggccgatctcccagcacaactaccgccccggctacttcacccagacggcggggccctggcacctgggcaagctcgagctggacttcgacctgtgcgagggcaccaccgtggtggtcgacgagcactgcgggaaccggggcccgagcctccgcaccacgaccgtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgacggggaccctggccgtgttcctgctcctgatcatgggccagctgacctggaacgacctcatccgcctgtgcatcatggtcggggccaacgcctccgaccggatgggcatgggcaccacgtacctggcgctcatggccaccttcaagatgcgcccgatgttcgccgtggggctgctgttccggcgcctcaccagccgggaggtgctgctgctcaccatcgggctgtccctggtcgccagcgtggagctccccaactccctggaggagctgggggacggcctcgccatgggcatcatgatgctgaagctgctcacggagttccagccccaccagctgtggaccaccctgctcagcctgaccttcgtcaagacgaccctgtccctcgactacgcgtggaagaccaccgccatggtgctgagcatcgtgtccctgttccccctctgcctgagcacgacctcccagaagaccacctggctgccggtcctcctggggagcttcggctgcaagcccctgaccatgttcttcatcacggagaacaagatctgggggcgcaagtcctggcccctcaacgagggcatcatggccatcgggatcgtgagcatcctgctgtccagcctcctgaagaacgacgtgcccctggccggcccgctcatcgcgggcgggatgctgatcgcctgctacgtcatcagcggctccagcgccgacctgtccctcgagaaggccgccgaggtgagctgggagcaggaggcggagcactccggggccagccacaacatcctggtggaggtccaggacgacggcaccatgaagatcaaggacgaggagcgggacgacaccctgaccatcctcctgaaggccacgctgctcgccgtgtccggggtgtaccccatgagcatccccgccaccctgttcgtctggtacttctggcagaagaagaagcagcgctccggcgtgctgtgggacacccccagcccgcccgaggtggagcgggcggtcctcgacgacggcatctaccgcatcctgcagcgggggctgctgggccgctcccaggtgggggtgggcgtcttccaggacggggtgttccacaccatgtggcacgtgacgcggggcgccgtcctcatgtaccagggcaagcgcctggagcccagctgggcctccgtgaagaaggacctgatcagctacgggggcgggtggcggttccagggctcctggaacaccggggaggaggtgcaggtcatcgccgtggagcccggcaagaacccgaagaacgtgcagaccacccccggcacgttcaagacccccgagggggaggtcggcgccatcgcgctcgacttcaagcccgggaccagcggctccccgatcgtgaaccgcgagggcaagatcgtggggctgtacggcaacggggtcgtgaccacgagcggcacctacgtgtccgccatcgcccaggccaaggccagccaggaggggcccctgcccgagatcgaggacgaggtcttcaagaagcggaacctcaccatcatggacctgcacccgggcagcggcaagacccgccggtacctgcccgcgatcgtgcgcgaggccatcaagcggaagctccgcacgctgatcctggcccccacccgcgtggtcgcctccgagatggcggaggccctcaaggggatgcccatccggtaccagaccaccgccgtcaagagcgagcacacgggccgcgagatcgtggacctgatgtgccacgccaccttcaccatgcggctgctctccccggtccgcgtgcccaactacaacatgatcatcatggacgaggcccacttcaccgaccccgcgagcatcgccgcccgggggtacatctccacgcgcgtgggcatgggggaggccgccgcgatcttcatgaccgccacgccgcccggcagcgtcgaggccttcccccagtccaacgccgtgatccaggacgaggagcgggacatccccgagcgcagctggaactccggctacgactggatcaccgacttccccgggaagacggtgtggttcgtccccagcatcaagtccggcaacgacatcgccaactgcctgcggaagaacgggaagcgcgtgatccagctgagccggaagaccttcgacaccgagtaccagaagaccaagaacaacgactgggactacgtggtcacgaccgacatctccgagatgggcgcgaacttccgcgccgaccgggtgatcgacccccgccggtgcctcaagcccgtgatcctgaaggacgggcccgagcgcgtcatcctggccggcccgatgcccgtgaccgtcgccagcgcggcccagcggcgcggccggatcgggcgcaaccagaacaaggagggcgaccagtacgtgtacatggggcagcccctcaacaacgacgaggaccacgcccactggaccgaggccaagatgctgctggacaacatcaacacgcccgagggcatcatcccggccctcttcgagcccgagcgcgagaagtccgcggccatcgacggggagtaccggctgcgcggcgaggcccggaagaccttcgtggagctgatgcgccggggcgacctccccgtctggctgagctacaaggtggcctccgaggggttccagtacagcgaccgccggtggtgcttcgacggcgagcgcaacaaccaggtgctggaggagaacatggacgtcgagatctggaccaaggagggggagcggaagaagctccgcccccggtggctggacgcccgcacctactccgacccgctggcgctccgggagttcaaggagttcgccgccggccgccggagcgtgagcggcgacctgatcctggagatcgggaagctcccccagcacctgaccctgcgcgcccagaacgccctcgacaacctggtgatgctgcacaactccgagcagggcgggaaggcgtaccggcacgccatggaggagctccccgacacgatcgagaccctgatgctgctcgccctgatcgccgtcctgaccggcggggtgaccctcttcttcctgagcggcaagggcctggggaagacgtccatcggcctcctgtgcgtgaccgcgagctccgccctgctctggatggccagcgtcgagccccactggatcgccgcctccatcatcctggagttcttcctgatggtgctcctgatcccggagcccgaccgccagcggacgccccaggacaaccagctggcgtacgtggtcatcgggctcctgttcatgatcctgaccgtggccgccaacgagatgggcctcctggagacgaccaagaaggacctggggatcggctacgtggccgccgagaaccaccagcacgcgaccatgctcgacgtcgacctgcgcccggccagcgcctggaccctgtacgccgtggccacgaccgtgatcacccccatgatgcggcacaccatcgagaacacgaccgcgaacatctccctcaccgccatcgccaaccaggccgccatcctgatgggcctggacaaggggtggcccatcagcaagatggacatcggcgtccccctcctggcgctggggtgctactcccaggtgaacccgctcaccctgacggccgccgtgctgatgctcgtcgcccactacgcgatcatcggccccgggctgcaggccaaggccacccgcgaggcccagaagcgcaccgccgcgggcatcatgaagaaccccaccgtggacggcatcgtggccatcgacctggaccccgtcgtgtacgacgccaagttcgagaagcagctcgggcagatcatgctgctgatcctctgcacgagccagatcctgctgatgcggaccacctgggccctctgcgagtccatcaccctggccacgggcccgctgaccaccctctgggaggggagccccggcaagttctggaacaccacgatcgcggtgtccatggccaacatcttccgcggcagctacctggccggggccggcctggccttctccctcatgaagtccctcgggggcgggcggcgcgggaccggcgcgcagggggagaccctgggcgagaagtggaagcggcagctcaaccagctgtccaagagcgagttcaacacctacaagcgcagcgggatcatggaggtcgaccggtccgaggccaaggagggcctgaagcgcggggagacgaccaagcacgccgtgagccggggcaccgccaagctccgctggttcgtggagcggaacctggtcaagcccgagggcaaggtgatcgacctggggtgcggccgcgggggctggtcctactactgcgcggggctgaagaaggtgaccgaggtcaagggctacaccaagggcgggcccggccacgaggagccgatccccatggccacgtacgggtggaacctcgtgaagctgcacagcggcaaggacgtgttcttcatgccgcccgagaagtgcgacaccctgctctgcgacatcggggagtccagcccgaaccccaccatcgaggagggccggaccctgcgcgtcctgaagatggtggagccctggctccggggcaaccagttctgcatcaagatcctgaacccctacatgccgtccgtggtcgagacgctggagcagatgcagcgcaagcacgggggcatgctcgtgcggaaccccctgagccgcaactccacccacgagatgtactgggtgagctgcgggaccggcaacatcgtctccgccgtgaacatgaccagccggatgctgctcaaccgcttcacgatggcccaccgcaagcccacctacgagcgggacgtggacctgggcgccgggacccgccacgtcgcggtggagcccgaggtggccaacctggacatcatcggccagcggatcgagaacatcaagaacgagcacaagtccacctggcactacgacgaggacaacccgtacaagacgtgggcctaccacgggagctacgaggtcaagccctccggcagcgcctccagcatggtgaacggggtcgtgcgcctcctgaccaagccctgggacgtgatccccatggtcacccagatcgccatgaccgacacgaccccgttcggccagcagcgggtgttcaaggagaaggtggacacccgcacgccccgggcgaagcgcggcacgacccagatcatggaggtcaccgccaagtggctgtgggggttcctctcccggaacaagaagccccgcatctgcacccgggaggagttcacgcgcaaggtgcggagcaacgccgccatcggcgccgtgttcgtcgacgagaaccagtggaacagcgcgaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggccaagggctcccgcgcgatctggtacatgtggctgggggcccggttcctggagttcgaggccctcggcttcatgaacgaggaccactggttcagccgcgagaactccctgagcggggtggagggcgaggggctgcacaagctcggctacatcctgcgggacatctccaagatcccgggcgggaacatgtacgccgacgacaccgccggctgggacacccgcatcacggaggacgacctgcagaacgaggcgaagatcaccgacatcatggagcccgagcacgccctcctggccaccagcatcttcaagctgacctaccagaacaaggtggtccgcgtgcagcggcccgccaagaacgggacggtgatggacgtcatctcccgccgggaccagcgcggcagcggccaggtggggacctacggcctcaacaccttcaccaacatggaggtgcagctgatccggcagatggagtccgaggggatcttcctgcccagcgagctcgagacgccgaacctggccgagcgcgtcctggactggctcgagaagcacggcgcggagcggctgaagcgcatggccatctccggggacgactgcgtggtgaagcccatcgacgaccggttcgccaccgccctgaccgccctcaacgacatgggcaaggtccgcaaggacatcccccagtgggagcccagcaagggctggaacgactggcagcaggtcccgttctgctcccaccacttccaccagctgatcatgaaggacgggcgggagatcgtggtcccctgccgcaaccaggacgagctggtgggccgggcgcgcgtgagccagggggccggctggtccctccgggagaccgcctgcctgggcaagagctacgcccagatgtggcagctgatgtacttccaccgccgggacctccgcctggccgcgaacgccatctgctccgccgtccccgtggactgggtgcccaccagccggacgacctggagcatccacgcccaccaccagtggatgaccaccgaggacatgctgtccgtctggaaccgcgtgtggatcgaggagaacccgtggatggaggacaagacgcacgtgagctcctgggaggaggtcccctacctcggcaagcgcgaggaccagtggtgcggcagcctgatcgggctgaccgcgcgggccacctgggccaccaacatccaggtggccatcaaccaggtgcgccggctcatcggcaacgagaactacctggactacatgacgtccatgaagcgcttcaagaacgagagcgaccccgagggggccctgtggtga

SEQ ID NO: 8272 - RNA, 9879 nt, synthetic construct
  misc_feature 1..9879: note = derived and/or modified CDS sequence (opt1) from DENV-1__GU131835__SS-prME
  source 1..9879: mol_type = other RNA
agcgtgaccatgctgctcatgctgctgcccaccgccctcgccttccacctgaccacccggggcggggagccgcacatgatcgtgagcaagcaggagcggggcaagagcctcctcttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggtgctgcgccaccccgggttcacggtgatcgccttcttcctggcccacgcgatcggcaccagcatcacccagaaggggatcatcttcatcctcctgatgctggtcaccccctccatggccatgcggtgcgtgggcatcggcaaccgcgacttcgtggaggggctcagcggcgccacgtgggtcgacgtggtgctggagcacgggtcctgcgtcaccaccatggccaagaacaagcccaccctggacatcgagctcctgaagacggaggtgaccaaccccgccgtgctgcggaagctctgcatcgaggcgaagatcagcaacaccaccacggactcccgctgcccgacccagggcgaggccaccctggccgaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccggctgatcaccgccaacccgatcgtcaccgacaaggagaagcccgtgaacatcgagaccgagccgcccttcggggagagctacatcgtggtcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtggggaagctcgtccaccaggtgttcggcaccgcctacggggtgctgttcagcggcgtctcctggacgatgaagatcgggatcggcatcctgctcacctggctgggcctgaacagccgctccaccagcctctccatgacctgcatcgccgtggggatggtgacgctgtacctgggcgtcatggtgcaggccgacagcgggtgcgtgatcaactggaagggccgggagctcaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcacggtcgtggtgggggacgccaacggcatcctcgcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacgaccagcgcgcctggaacatctgggaggtcgaggactacggcttcgggatcttcacgaccaacatctggctgaagctgcgggactcctacacccagatgtgcgaccaccgcctcatgagcgcggccatcaaggactccaaggccgtgcacgccgacatgggctactggatcgagagcgagaagaacgagacctggaagctggcccgggcgtccttcatcgaggtgaagacgtgcacctggcccaagagccacaccctgtggtccaacggcgtcctcgagagcgagatgatcatccccaagatctacgggggcccgatctcccagcacaactaccgccccgggtacttcacccagacggccggcccctggcacctggggaagctggagctcgacttcgacctgtgcgagggcaccaccgtggtggtcgacgagcactgcggcaaccgggggccgagcctgcgcaccacgaccgtgaccggcaagatcatccacgagtggtgctgccggtcctgcaccctgccgcccctccgcttccgcggggaggacggctgctggtacgggatggagatccgccccgtgaaggagaaggaggagaacctggtccggagcatggtgtccgccggcagcggcgaggtggacagcttctccctcgggatcctgtgcgtcagcatcatgatcgaggaggtgatgcgctcccggtggagccgcaagatgctgatgacgggcaccctcgccgtgttcctgctgctcatcatggggcagctgacctggaacgacctgatccgcctctgcatcatggtcggcgccaacgcgtccgaccggatggggatgggcaccacgtacctggccctgatggccaccttcaagatgcgcccgatgttcgccgtgggcctcctgttccggcgcctgaccagccgggaggtgctcctgctgaccatcgggctctccctggtcgccagcgtggagctgcccaactccctcgaggagctgggcgacgggctggcgatgggcatcatgatgctcaagctgctgacggagttccagccccaccagctctggaccaccctgctgagcctcaccttcatcaagacgaccctgtccctggactacgcctggaagaccaccgccatggtcctcagcatcgtgtccctgttccccctgtgcctcagcacgacctcccagaagaccacctggctgccggtgctgctcggcagcttcgggtgcaagcccctgaccatgttcctgatcacggagaacaagatctggggccgcaagtcctggcccctcaacgaggggatcatggccatcggcatcgtcagcatcctgctgtccagcctcctgaagaacgacgtgcccctggcggggccgctcatcgccggcggcatgctgatcgcctgctacgtgatcagcgggtccagcgccgacctgtccctcgagaaggccgcggaggtcagctgggagcaggaggccgagcactccggcaccagccacaacatcctggtggaggtgcaggacgacgggaccatgaagatcaaggacgaggagcgggacgacaccctgacgatcctcctgaaggccaccctgctcgccgtctccggcgtgtaccccatgagcatccccgccaccctgttcgtgtggtacttctggcagaagaagaagcagcgctccggggtcctgtgggacacccccagcccgcccgaggtggagcgggcggtgctcgacgacggcatctaccgcatcctgcagcggggcctgctggggcgctcccaggtcggcgtgggggtgttccaggacggcgtcttccacacgatgtggcacgtgacccgcggggccgtgctcatgtaccagggcaagcgcctggagcccagctgggcctccgtcaagaaggacctgatcagctacggcgggggctggcggttccaggggtcctggaacaccggcgaggaggtccaggtgatcgccgtcgagcccgggaagaacccgaagaacgtgcagaccacgcccggcaccttcaagacccccgagggcgaggtgggggccatcgcgctcgacttcaagcccggcaccagcgggtccccgatcgtcaaccgcgagggcaagatcgtgggcctgtacgggaacggcgtggtcacgaccagcgggacctacgtgtccgccatcgcccaggccaaggccagccaggagggccccctgcccgagatcgaggacgaggtgttcaagaagcggaacctcaccatcatggacctgcacccggggagcggcaagacgcgccggtacctgcccgcgatcgtccgcgaggccatgaagcggaagctccgcaccctgatcctggcccccacccgcgtggtggcctccgagatggcggaggccctcaagggcatgcccatccggtaccagaccacggccgtcaagagcgagcacaccgggcgcgagatcgtggacctgatgtgccacgccaccttcaccatgcggctgctctccccggtgcgcgtccccaactacaacatgatcatcatggacgaggcccacttcacggaccccgcgagcatcgccgcccggggctacatctccacccgcgtggggatgggcgaggccgccgcgatcttcatgaccgccacgccgcccgggagcgtggaggccttcccccagtccaacgccgtcatccaggacgaggagcgggacatccccgagcgcagctggaactccggctacgagtggatcacggacttccccggcaagaccgtgtggttcgtgcccagcatcaagtccgggaacgacatcgccaactgcctgcggaagaacggcaagcgcgtcatccagctgagccggaagaccttcgacaccgagtaccagaagacgaagaacaacgactgggactacgtggtgaccaccgacatctccgagatgggggcgaacttccgcgccgaccgggtcatcgacccccgccggtgcctcaagcccgtgatcctgaaggacggccccgagcgcgtgatcctggccgggccgatgcccgtcaccgtggccagcgcggcccagcggcgcggccggatcggccgcaaccagaacaaggagggggaccagtacgtctacatgggccagcccctcaacaacgacgaggaccacgcccactggacggaggccaagatgctgctggacaacatcaacacccccgaggggatcatcccggccctcttcgagcccgagcgcgagaagtccgcggccatcgacggcgagtaccggctgcgcggggaggcccggaagaccttcgtggagctgatgcgccggggcgacctccccgtgtggctgagctacaaggtcgcctccgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacctactccgacccgctggcgctccgggagttcaaggagttcgccgccgggcgccggagcgtcagcggcgacctgatcctggagatcggcaagctcccccagcacctgacgctgcgcgcccagaacgccctcgacaacctggtgatgctgcacaactccgagcagggcgggaaggcgtaccggcacgccatggaggagctccccgacaccatcgagaccctgatgctgctcgccctgatcgccgtgctgaccgggggcgtcatgctgttcttcctgagcgggaagggcctgggcaagacgtccatcgggctcctgtgcgtgaccgcgagctccgccctgctctggatggccagcgtggagccccactggatcgccgcctccatcgtcctggagttcttcctgatggtgctcctgatcccggagcccgaccgccagcggacgccccaggacaaccagctggcgtacgtggtcatcggcctcctgttcatgatcctgaccgtggccgccaacgagatggggctcctggagacgaccaagaaggacctgggcatcgggcacgccgccgcggagaaccaccagcacgccaccatgctcgacgtggacctgcgcccggccagcgcctggaccctgtacgccgtcgcgacgaccgtgatcacccccatgatgcggcacaccatcgagaacacgaccgccaacatctccctcaccgccatcgccaaccaggccgcgatcctgatgggcctggacaagggctggcccatcagcaagatggacatcggggtgcccctcctggccctgggctgctactcccaggtcaacccgctcaccctgacggccgccgtgctgatgctcgtggcgcactacgccatcatcgggcccggcctgcaggccaaggccacccgcgaggcccagaagcgcaccgcggccgggatcatgaagaaccccaccgtcgacggcatcgtggccatcgacctggaccccgtggtctacgacgccaagttcgagaagcagctcggccagatcatgctgctgatcctctgcacgagccagatcctgctgatgcggaccacctgggccctctgcgagtccatcaccctggcgacggggccgctgaccaccctctgggagggcagccccgggaagttctggaacaccacgatcgccgtgtccatggccaacatcttccgcggcagctacctggccggcgccgggctggcgttctccctcatgaagtccctgggcgggggccggcgcgggaccggcgcccagggcgagaccctgggggagaagtggaagcggcagctcaaccagctgtccaagcccgagttcaacacctacaagcgcagcggcatcatggaggtggaccggagcgaggccaaggaggggctgaagcgcggcgagacgaccaagcacgccgtctcccgggggaccgcgaagctccgctggttcgtggagcggaacctggtgaagcccgagggcaaggtcatcgacctgggctgcgggcgcggcgggtggagctactactgcgccggcctgaagaaggtgaccgaggtgaaggggtacaccaagggcggcccggggcacgaggagcccatccccatggccacgtacggctggaacctcgtcaagctgcactccgggaaggacgtgttcttcatgcccccggagaagtgcgacaccctgctctgcgacatcggcgagagctcccccaaccccaccatcgaggaggggcggaccctgcgcgtgctgaagatggtcgagccctggctccggggcaaccagttctgcatcaagatcctgaacccgtacatgcccacggtggtggagaccctggagcagatgcagcgcaagcacggcgggatgctcgtccggaaccccctgagccgcaactccacccacgagatgtactgggtgagctgcggcaccgggaacatcgtgtccgccgtcaacatgacgagccggatgctgctcaaccgcttcaccatggcccaccgcaagcccacctacgagcgggacgtggacctgggcgcgggcacccgccacgtggccgtcgagccggaggtggccaacctggacatcatcgggcagcggatcgagaacatcaagaacgagcacaagtccacgtggcactacgacgaggacaacccctacaagacctgggcctaccacggcagctacgaggtgaagccctccgggagcgcctccagcatggtcaacggcgtggtccgcctcctgaccaagccctgggacgtgatcccgatggtgacccagatcgcgatgacggacaccacccccttcgggcagcagcgggtcttcaaggagaaggtggacacccgcacgccccgggccaagcgcggcaccacccagatcatggaggtgaccgccaagtggctgtggggcttcctctcccggaacaagaagccgcgcatctgcacgcgggaggagttcacccgcaaggtccggagcaacgccgccatcggggcggtgttcgtggacgagaaccagtggaactccgccaaggaggccgtcgaggacgagcgcttctgggacctggtgcaccgggagcgcgagctgcacaagcagggcaagtgcgcgacctgcgtgtacaacatgatggggaagcgggagaagaagctcggcgagttcgggaaggcgaagggcagccgcgccatctggtacatgtggctgggcgcccggttcctggagttcgaggccctcgggttcatgaacgaggaccactggttcagccgcgagaactccctgagcggcgtcgagggggagggcctgcacaagctcgggtacatcctgcgggacatctcccgcatccccggcggcaacatgtacgccgacgacaccgcggggtgggacacgcgcatcaccgaggacgacctgcagaacgaggccaagatcaccgacatcatggagcccgagcacgccctcctggccaccagcatcttcaagctgacgtaccagaacaaggtggtgcgggtccagcgccccgccaagaacggcaccgtgatggacgtgatctcccggcgcgaccagcgggggagcggccaggtcggcacctacgggctcaacaccttcacgaacatggaggtgcagctgatccgccagatggagtccgagggcatcttcctgccgagcgagctcgagacccccaacctggcggagcgggtgctggactggctcgagaagcacggggccgagcgcctgaagcggatggccatctccggcgacgactgcgtcgtgaagcccatcgacgaccgcttcgccaccagcctgaccgccctcaacgacatggggaaggtgcggaaggacatcccccagtgggagccgtccaagggctggaacgactggcagcaggtccccttctgcagccaccacttccaccagctgatcatgaaggacggccgcgagatcgtggtgccctgccggaaccaggacgagctggtcgggcgcgcgcgggtgtcccagggcgccgggtggagcctccgcgagaccgcctgcctgggcaagtcctacgcccagatgtggcagctgatgtacttccaccggcgcgacctccggctggccgcgaacgccatctgcagcgccgtgcccgtcgactgggtgccgacgtcccgcaccacctggagcatccacgcccaccaccagtggatgaccacggaggacatgctgagcgtgtggaaccgcgtctggatcgaggagaacccctggatggaggacaagacccacgtgtccagctgggaggaggtgccctacctcgggaagcgggaggaccagtggtgcggctccctgatcggcctgaccgcgcgcgccacctgggccacgaacatccaggtcgccatcaaccaggtgcggcgcctcatcgggaacgagaactacctggactacatgaccagcatgaagcggttcaagaacgagtccgacctggagggcgccctctggtga

SEQ ID NO: 8273 - RNA, 9879 nt, synthetic construct
  misc_feature 1..9879: note = derived and/or modified CDS sequence (opt1) from DENV-1__GU131836__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccggctcatcaccgccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccacggcccgcggggcccggcgcatggccatcctcggcgacaccgcgtgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgccaacggcatcctggtccaggggaagaagatgatccggccccagcccatggagcacaagtactcctggaagtcctggggcaaggcgaagatcatcggcgccgacatccagaacaccaccttcatcatcgacgggcccgacaccccggagtgccccgacgaccagcgcgcctggaacatctgggaggtggaggactacggcttcgggatcttcacgaccaacatctggctgaagctccgggactcctacacccagatgtgcgaccaccgcctgatgagcgccgcgatcaaggactccaaggccgtgcacgccgacatgggctactggatcgagagcgagaagaacgagacctggaagctgtcccgggccagcttcatcgaggtcaagacgtgcacctggcccaagtcccacaccctctggagcaacggcgtgctggagtccgagatgatcatccccaagatctacgggggcccgatcagccagcacaactaccgccccgggtacttcacccagacggccggcccctggcacctggggaagctcgagctggacttcgacctgtgcgagggcaccaccgtggtcgtggacgagcactgcggcaaccgggggccgtccctccgcaccacgaccgtgaccggcaagatcatccacgagtggtgctgccggagctgcaccctgccgcccctgcgcttccgcggggaggacggctgctggtacgggatggagatccgccccgtcaaggagaaggaggagaacctcgtgcggtccatggtgagcgcgggcagcggcgaggtcgactccttcagcctggggatcctgtgcgtgtccatcatgatcgaggaggtgatgcgcagccggtggtcccgcaagatgctcatgacgggcaccctggccgtcttcctgctcctgatcatggggcagctgacctggaacgacctcatccgcctgtgcatcatggtgggcgccaacgccagcgaccggatggggatgggcaccacgtacctggccctcatggcgaccttcaagatgcgcccgatgttcgccgtggggctgctgttccggcgcctcacctcccgggaggtcctgctgctcaccatcgggctgagcctggtggcctccgtcgagctccccaacagcctggaggagctgggcgacgggctcgccatgggcatcatgatgctgaagctgctcacggagttccagccccaccagctgtggaccaccctgctctccctgaccttcatcaagacgaccctgagcctcgactacgcctggaagaccaccgcgatggccctgtccatcgtgagcctgttccccctctgcctgtccacgaccagccagaagaccacctggctgccggtgctcctgggctccttcgggtgcaagcccctgaccatgttcctcatcacggagaacaagatctggggccgcaagagctggcccctgaacgaggggatcatggccatcggcatcgtctccatcctgctcagcagcctgctgaagaacgacgtgcccctcgccgggccgctgatcgcgggcggcatgctgatcgcctgctacgtgatctccgggagctccgccgacctcagcctggagaaggccgccgaggtctcctgggagcaggaggcggagcacagcggcacctcccacaacatcctggtggaggtgcaggacgacgggaccatgaagatcaaggacgaggagaaggacgacaccctcacgatcctgctgaaggccaccctcctggccgtcagcggcgtgtaccccatgtccatccccgccaccctgttcgtgtggtacttctggcagaagaagaagcagcggagcggggtcctctgggacaccccctccccgcccgaggtggagcgcgccgtgctggacgacggcatctaccggatcctgcagcgcggcctgctcgggcggagccaggtcggcgtgggggtgttccaggacggcgtcttccacacgatgtggcacgtgacccgcggggcggtgctgatgtaccagggcaagcggctggagccctcctgggccagcgtcaagaaggacctcatctcctacggcgggggctggcgcttccaggggagctggaacaccggcgaggaggtccaggtgatcgccgtcgagcccgggaagaacccgaagaacgtgcagaccacgcccggcaccttcaagacccccgagggcgaggtgggggccatcgccctggacttcaagcccggcacctccgggagcccgatcgtcaaccgggagggcaagatcgtgggcctgtacgggaacggcgtggtcacgacctccgggacctacgtgagcgcgatcgcccaggccaaggccagccaggagggccccctccccgagatcgaggacgaggtgttcaagaagcgcaacctgaccatcatggacctgcacccggggtccggcaagacgcggcgctacctccccgccatcgtccgggaggcgatcaagcgcaagctgcggaccctgatcctcgcccccacccgcgtggtggccagcgagatggccgaggcgctgaagggcatgcccatccgctaccagaccacggccgtcaagtccgagcacaccgggcgggagatcgtggacctgatgtgccacgccaccttcaccatgcgcctcctgagcccggtgcgggtccccaactacaacatgatcatcatggacgaggcccacttcacggaccccgcctccatcgcggcccgcggctacatcagcacccgggtggggatgggcgaggccgccgccatcttcatgaccgcgacgccgcccgggtccgtggaggccttcccccagagcaacgccgtcatccaggacgaggagcgcgacatccccgagcggtcctggaacagcggctacgactggatcacggacttccccggcaagaccgtgtggttcgtgccctccatcaagagcgggaacgacatcgccaactgcctgcgcaagaacggcaagcgggtcatccagctctcccgcaagaccttcgacaccgagtaccagaagacgaagaacaacgactgggactacgtggtgaccaccgacatcagcgagatgggggccaacttccgggcggaccgcgtcatcgacccccggcgctgcctgaagcccgtgatcctgaaggacggccccgagcgggtgatcctcgccgggccgatgcccgtcaccgtggcctccgccgcgcagcgccggggccgcatcggccggaaccagaacaaggagggggaccagtacgtctacatgggccagcccctgaacaacgacgaggaccacgcccactggacggaggccaagatgctgctcgacaacatcaacacccccgaggggatcatcccggccctgttcgagcccgagcgcgagaagtccgccgcgatcgacggcgagtaccgcctgcgcggggaggcccgcaagaccttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacctacagcgacccgctcgccctgcgcgagttcaaggagttcgcggccgggcggcgcagcgtctccggcgacctgatcctcgagatcggcaagctgccccagcacctgacgctccgggcccagaacgccctggacaacctggtgatgctccacaacagcgagcagggcgggaaggcctaccgccacgcgatggaggagctgcccgacaccatcgagaccctgatgctcctggccctgatcgccgtgctcaccgggggcgtcacgctgttcttcctgtccgggaagggcctcggcaagaccagcatcgggctgctgtgcgtgatggcctccagcgcgctcctgtggatggcctccgtggagccccactggatcgccgccagcatcatcctggagttcttcctcatggtcctgctgatcccggagcccgaccggcagcgcacgccccaggacaaccagctcgcctacgtggtgatcggcctgctgttcatgatcctcaccgtcgcggccaacgagatggggctgctggagacgaccaagaaggacctcggcatcgggcacgtggccgccgagaaccaccagcacgccaccatgctggacgtggacctgcggccggcgtccgcctggaccctctacgccgtcgccacgaccgtgatcacccccatgatgcgccacaccatcgagaacacgaccgccaacatcagcctgaccgcgatcgccaaccaggccgccatcctgatgggcctcgacaagggctggcccatctccaagatggacatcggggtgcccctgctggccctcggctgctacagccaggtcaacccgctgaccctgacggcggccgtgctcatgctggtggcccactacgccatcatcgggcccggcctgcaggcgaaggccacccgggaggcccagaagcgcaccgccgccgggatcatgaagaaccccaccgtcgacggcatcgtggcgatcgacctcgaccccgtggtctacgacgccaagttcgagaagcagctgggccagatcatgctgctcatcctgtgcacgtcccagatcctgctcatgcgcaccacctgggccctgtgcgagagcatcaccctggccacggggccgctcaccaccctgtgggagggctcccccgggaagttctggaacaccacgatcgccgtgagcatggcgaacatcttccggggctcctacctggccggcgccgggctcgccttcagcctgatgaagtccctgggcgggggccgccgggggaccggcgcccagggcgagaccctcggggagaagtggaagcgccagctgaaccagctgagcaagagcgagttcaacacctacaagcggtccggcatcatggaggtggaccgcagcgaggcgaaggaggggctcaagcggggcgagacgaccaagcacgccgtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacaccaagggcggccccgggcacgaggagccgatccccatggcgacgtacggctggaacctggtcaagctgcactccgggaaggacgtgttcttcatgccgcccgagaagtgcgacaccctcctgtgcgacatcggcgagagctccccgaaccccaccatcgaggaggggcgcaccctgcgggtgctcaagatggtcgagccctggctgcgcggcaaccagttctgcatcaagatcctgaacccctacatgccgagcgtggtggagacgctcgagcagatgcagcggaagcacggcgggatgctggtccgcaaccccctgtcccggaacagcacccacgagatgtactgggtgtcctgcggcaccgggaacatcgtgagcgccgtcaacatgacctcccgcatgctcctgaaccggttcacgatggcccaccgcaagcccacctacgagcgcgacgtggacctgggcgccggcacccggcacgtggccgtcgagcccgaggtgccgaacctcgacatcatcgggcagcgcatcgagaacatcaagaacgagcacaagagcacctggcactacgacgaggacaacccctacaagacgtgggcgtaccacggctcctacgaggtgaagcccagcgggtccgccagctccatggtcaacggcgtggtccggctgctgaccaagccctgggacgtgatcccgatggtgacccagatcgccatgaccgacacgacccccttcgggcagcagcgcgtcttcaaggagaaggtggacacccggacgccccgggccaagcggggcacgacccagatcatggaggtgaccgccaagtggctctggggcttcctgagccgcaacaagaagccgcggatctgcacccgcgaggagttcacgcggaaggtccgcagcaacgcggccatcggggccgtgttcgtggacgagaaccagtggaactccgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggcgctggggttcatgaacgaggaccactggttctcccgggagaacagcctgtccggcgtcgagggggagggcctccacaagctggggtacatcctgcgcgacatcagcaagatccccggcggcaacatgtacgccgacgacaccgccgggtgggacacccggatcacggaggacgacctccagaacgaggccaagatcaccgacatcatggagcccggccacgccctgctggcgacctccatcttcaagctcacctaccagaacaaggtggtgcgcgtccagcgccccgccaagaacgggacggtgatggacgtgatcagccggcgcgaccagcggggctccggccaggtcgggacctacggcctgaacaccttcaccaacatggaggtgcagctgatccgccagatggagagcgaggggatcttcctcccgtccgagctggagacgcccaacctggccgagcgggtgctcgactggctggagaagcacggcgccgagcgcctgaagcggatggccatcagcggggacgactgcgtcgtgaagcccatcgacgaccgcttcgcgaccgccctcaccgccctgaacgacatgggcaaggtgcggaaggacatcccccagtgggagccgtccaagggctggaacgactggcagcaggtccccttctgcagccaccacttccaccagctgatcatgaaggacgggcgcgagatcgtggtgccctgccggaaccaggacgagctcgtcggccgcgcccgggtgtcccagggggccggctggagcctgcgcgagaccgcgtgcctggggaagtcctacgcccagatgtggcagctcatgtacttccaccggcgcgacctgcggctggccgccaacgccatctgcagcgcggtgcccgtcgactgggtgccgaccagccgcacgacctggtccatccacgcccaccaccagtggatgaccaccgaggacatgctcagcgtgtggaaccgggtctggatcgaggagaacccctggatggaggacaagacgcacgtgtccagctgggaggaggtgccctacctgggcaagcgcgaggaccagtggtgcggctccctgatcgggctcaccgcccgcgccacctgggcgaccaacatccaggtcgccatcaaccaggtgcggcgcctgatcggcaacgagaactacctggactacatgacgagcatgaagcggttcaagaacgagtccgaccccgagggggccctctggtga

SEQ ID NO: 8274 - RNA, 9879 nt, synthetic construct
  misc_feature 1..9879: note = derived and/or modified CDS sequence (opt1) from DENV-1__GU131837__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacctacctggccctcatggccacgttcaagatgcgcccgatgttcgccgtggggctgctgttccggcgcctcaccagccgggaggtgctgctgctcaccatcgggctgtccctggtcgccagcgtggagctccccaactccctggaggagctgggggacggcctcgcgatgggcatcatgatgctgaagctgctcaccgagttccagccccaccagctgtggacgaccctgctcagcctgaccttcgtcaagaccacgctgtccctcgactacgcctggaagaccaccgccatggtgctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcacgatgaagatcaaggacgaggagcgggacgacaccctcaccatcctgctgaaggccaccctcctggccgtgtccggggtgtaccccatgagcatccccgcgacgctgttcgtctggtacttctggcagaagaagaagcagcgctccggcgtgctctgggacacccccagcccgcccgaggtggagcgggccgtcctggacgacggcatctaccgcatcctgcagcgggggctgctcggccgctcccaggtgggggtgggcgtcttccaggacggggtgttccacaccatgtggcacgtgacccggggcgccgtcctgatgtaccagggcaagcgcctggagcccagctgggcctccgtgaagaaggacctcatcagctacgggggcgggtggcggttccagggctcctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggaccagcggctccccgatcgtgaaccgcgagggcaagatcgtggggctgtacggcaacggggtcgtgaccaccagcggcacgtacgtgtccgccatcgcccaggccaaggcgagccaggaggggcccctccccgagatcgaggacgaggtcttcaagaagcggaacctgaccatcatggacctgcacccgggcagcggcaagacccgccggtacctccccgccatcgtgcgcgaggccatcaagcggaagctgcgcaccctgatcctcgcccccacgcgcgtggtcgcgtccgagatggccgaggccctgaaggggatgcccatccggtaccagaccaccgccgtcaagagcgagcacaccggccgcgagatcgtggacctgatgtgccacgccacgttcaccatgcggctcctgtccccggtccgcgtgcccaactacaacatgatcatcatggacgaggcgcacttcaccgaccccgccagcatcgccgcccgggggtacatctccacccgcgtgggcatgggggaggccgcggccatcttcatgacggccacgccgcccggcagcgtcgaggccttcccccagtccaacgccgtgatccaggacgaggagcgggacatccccgagcgcagctggaactccggctacgactggatcaccgacttccccgggaagaccgtgtggttcgtccccagcatcaagtccggcaacgacatcgcgaactgcctgcggaagaacgggaagcgcgtgatccagctcagccggaagacgttcgacaccgagtaccagaagaccaagaacaacgactgggactacgtggtcaccacggacatctccgagatgggcgccaacttccgcgccgaccgggtgatcgacccccgccggtgcctgaagcccgtgatcctgaaggacgggcccgagcgcgtcatcctcgccggcccgatgcccgtgaccgtcgcgagcgccgcccagcggcgcggccggatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagacgttcgtggagctcatgcgccggggcgacctgcccgtctggctgagctacaaggtggcctccgaggggttccagtacagcgaccgccggtggtgcttcgacggcgagcgcaacaaccaggtgctcgaggagaacatggacgtcgagatctggaccaaggagggggagcggaagaagctgcgcccccggtggctggacgcgcgcacctactccgacccgctcgccctgcgggagttcaaggagttcgccgccggccgccggagcgtgagcggcgacctgatcctcgagatcgggaagctgccccagcacctgaccctccgcgcccagaacgcgctggacaacctggtgatgctccacaactccgagcagggcgggaaggcctaccggcacgccatggaggagctgcccgacaccatcgagacgctgatgctcctggccctgatcgcggtcctcaccggcggggtgaccctgttcttcctgagcggcaagggcctcgggaagacctccatcggcctgctgtgcgtgacggccagctccgccctcctgtggatggccagcgtcgagccccactggatcgccgcgtccatcatcctggagttcttcctcatggtgctgctgatcccggagcccgaccgccagcggacgccccaggacaaccagctcgcctacgtggtcatcgggctgctgttcatgatcctcaccgtggccgccaacgagatgggcctgctggagaccacgaagaaggacctcgggatcggctacgtggccgcggagaaccaccagcacgccaccatgctggacgtcgacctgcgcccggccagcgcctggaccctctacgccgtggcgaccacggtgatcacccccatgatgcggcacaccatcgagaacaccacggccaacatctccctgaccgccatcgccaaccaggccgcgatcctgatgggcctcgacaaggggtggcccatcagcaagatggacatcggcgtccccctgctggccctcgggtgctactcccaggtgaacccgctgaccctgaccgccgccgtgctcatgctggtcgcgcactacgccatcatcggccccgggctgcaggccaaggccacgcgcgaggcccagaagcgcaccgcggccggcatcatgaagaaccccaccgtggacggcatcgtggccatcgacctcgaccccgtcgtgtacgacgccaagttcgagaagcagctggggcagatcatgctgctcatcctgtgcaccagccagatcctgctcatgcggacgacctgggccctgtgcgagtccatcaccctggcgaccggcccgctcacgaccctgtgggaggggagccccggcaagttctggaacaccaccatcgccgtgtccatggccaacatcttccgcggcagctacctggccggggccggcctcgcgttctccctgatgaagtccctcgggggcgggcggcgcgggacgggcgcccagggggagaccctcggcgagaagtggaagcggcagctgaaccagctgtccaagagcgagttcaacacctacaagcgcagcgggatcatggaggtcgaccggtccgaggccaaggagggcctcaagcgcggggagaccacgaagcacgccgtgagccggggcaccgcgaagctgcgctggttcgtggagcggaacctggtcaagcccgagggcaaggtgatcgacctggggtgcggccgcgggggctggtcctactactgcgccgggctcaagaaggtgaccgaggtcaagggctacaccaagggcgggcccggccacgaggagccgatccccatggccacctacgggtggaacctggtgaagctgcacagcggcaaggacgtgttcttcatgccgcccgagaagtgcgacacgctcctgtgcgacatcggggagtccagcccgaaccccaccatcgaggagggccggaccctgcgcgtcctcaagatggtggagccctggctgcggggcaaccagttctgcatcaagatcctgaacccctacatgccgtccgtggtcgagaccctcgagcagatgcagcgcaagcacgggggcatgctggtgcggaaccccctgagccgcaactccacgcacgagatgtactgggtgagctgcgggaccggcaacatcgtctccgccgtgaacatgaccagccggatgctcctgaaccgcttcaccatggcccaccgcaagcccacgtacgagcgggacgtggacctgggcgcggggacccgccacgtcgccgtggagcccgaggaggccaacctcgacatcatcggccagcggatcgagaacatcaagaacgagcacaagtccacctggcactacgacgaggacaacccgtacaagacctgggcctaccacgggagctacgaggtgaagccctccggcagcgcctccagcatggtcaacggggtggtccgcctgctgacgaagccctgggacgtgatccccatggtgacccagatcgcgatgaccgacaccacgccgttcggccagcagcgggtcttcaaggagaaggtggacacccgcacgccccgggccaagcgcggcaccacgcagatcatggaggtgaccgccaagtggctctgggggttcctgtcccggaacaagaagccccgcatctgcacccgggaggagttcacccgcaaggtccggagcaacgccgccatcggcgcggtgttcgtggacgagaaccagtggaacagcgccaaggaggccgtcgaggacgagcgcttctgggacctggtgcaccgggagcgcgagctccacaagcaggggaagtgcgccacgtgcgtgtacaacatgatgggcaagcgggagaagaagctgggggagttcggcaaggcgaagggctcccgcgccatctggtacatgtggctgggggcccggttcctcgagttcgaggccctgggcttcatgaacgaggaccactggttcagccgcgagaactccctgagcggggtcgagggcgaggggctccacaagctgggctacatcctgcgggacatctccaagatcccgggcgggaacatgtacgccgacgacaccgcgggctgggacacccgcatcaccgaggacgacctccagaacgaggccaagatcacggacatcatggagcccgagcacgccctgctggccaccagcatcttcaagctcacctaccagaacaaggtggtgcgcgtccagcggcccgccaagaacgggaccgtgatggacgtgatctcccgccgggaccagcgcggcagcggccaggtcgggacgtacggcctgaacaccttcaccaacatggaggtgcagctgatccggcagatggagtccgaggggatcttcctccccagcgagctggagaccccgaacctggcggagcgcgtgctcgactggctggagaagcacggcacggagcggctgaagcgcatggccatctccggggacgactgcgtcgtgaagcccatcgacgaccggttcgccaccgccctcaccgccctgaacgacatgggcaaggtgcgcaaggacatcccccagtgggagcccagcaagggctggaacgactggcagcaggtcccgttctgctcccaccacttccaccagctgatcatgaaggacgggcgggagatcgtggtgccctgccgcaaccaggacgagctcgtcggccgggcgcgcgtgagccagggggccggctggtccctgcgggagaccgcctgcctgggcaagagctacgcccagatgtggcagctcatgtacttccaccgccgggacctgcgcctggccgcgaacgccatctgctccgccgtgcccgtcgactgggtgcccaccagccggacgacctggagcatccacgcccaccaccagtggatgaccaccgaggacatgctctccgtgtggaaccgcgtctggatcgaggagaacccgtggatggaggacaagacgcacgtgagctcctgggaggaggtgccctacctgggcaagcgcgaggaccagtggtgcggcagcctgatcgggctcaccgcgcgggccacctgggccaccaacatccaggtcgccatcaaccaggtgcgccggctgatcggcaacgagaactacctggactacatgacgtccatgaagcgcttcaagaacgagagcgaccccgagggggccctctggtga

SEQ ID NO: 8275 - RNA, 9879 nt, synthetic construct
  misc_feature 1..9879: note = derived and/or modified CDS sequence (opt1) from DENV-1__JN819415__SS-prME
  source 1..9879: mol_type = other RNA
agcgtgaccatgctgctcatgctgctgcccaccgccctcgccttccacctgacgacccggggcggggagccccacatgatcgtgagcaagcaggagcggggcaagagcctcctgttcaagaccagcgccggggtgaacatgtgcaccctgatcgccatggacctgggcgagctctgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgaccgccctgttcctcgcgcacgccatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgcggtgctccggaagctgtgcatcgaggccaagatcagcaacaccacgaccgactcccgctgccccacccagggcgaggccaccctggtggaggagcaggacgccaacttcgtctgccggcgcacgttcgtggaccggggctgggggaacggctgcggcctcttcggcaaggggagcctgctgacctgcgccaagttcaagtgcgtgaccaagctcgagggcaagatcgtccagtacgagaacctgaagtactccgtgatcgtgaccgtccacacgggcgaccagcaccaggtggggaacgagaccaccgagcacggcaccatcgcgaccatcacgccccaggcccccaccagcgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggacctccggggccagcaccagccaggagacgtggaaccggcaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcacctcctacgtcatgtgcacggggagcttcaagctggagaaggaggtggcggagacccagcacggcaccgtgctggtccaggtgaagtacgagggcaccgacgccccctgcaagatccccttctccacgcaggacgagaagggggtgacccagaacggccggctcatcaccgccaacccgatcgtcaccgacaaggagaagcccgtgaacatcgagacggagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacaccgcgtgggacttcgggagcatcggcggcgtgttcacctccgtggggaagctggtccaccaggtgttcggcacggcctacggggtgctgttcagcggcgtctcctggaccatgaagatcgggatcggcatcctcctgacctggctgggcctcaacagccgctccaccagcctgtccatgacgtgcatcgccgtggggatggtgaccctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacgcgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacacgccggagtgccccgacgaccagcgcgcctggaacatctgggaggtcgaggactacggcttcgggatcttcaccaccaacatctggctgaagctccgggactcctacacccagatgtgcgaccaccgcctgatgagcgcggccatcaaggactccaaggccgtgcacgccgacatgggctactggatcgagagcgagaagaacgagacgtggaagctggcccgggcgtccttcatcgaggtgaagacctgcacctggcccaagagccacaccctctggtccaacggcgtcctggagagcgagatgatcatccccaagatctacgggggcccgatctcccagcacaactaccgccccgggtacttcacgcagaccgccggcccctggcacctggggaagctcgagctggacttcaacctgtgcgagggcaccaccgtggtggtcgacgagcactgcggcaaccgggggccgagcctccgcacgaccaccgtgaccggcaagatcatccacgagtggtgctgccggtcctgcacgctgccgcccctgcgcttccgcggggaggacggctgctggtacgggatggagatccgccccgtgaaggagaaggaggagaacctcgtccggagcatggtgtccgccggcagcggcgaggtggacagcttctccctggggatcctgtgcgtcagcatcatgatcgaggaggtgatgcgctcccggtggagccgcaagatgctcatgaccggcaccctggccgtgttcctgctcctgatcatggggcagctgacctggaacgacctcatccgcctgtgcatcatggtcggcgccaacgcgtccgaccggatggggatgggcacgacctacctggccctcatggccaccttcaagatgcgcccgatgttcgccgtgggcctgctgttccggcgcctcaccagccgggaggtgctgctgctcacgatcgggctgtccctggtcgccagcgtggagctccccaactccctggaggagctgggcgacgggctcgcgatgggcatcatgatgctgaagctgctcaccgagttccagccccaccagctgtggaccaccctgctcagcctgacgttcatcaagaccaccctgtccctcgactacgcctggaagaccacggccatggccctgagcatcgtctccctgttccccctctgcctgagcaccacctcccagaagaccacctggctgccggtgctcctgggcagcttcgggtgcaagcccctgacgatgttcctcatcaccgagaacaagatctggggccgcaagtcctggcccctgaacgaggggatcatggcgatcggcatcgtgagcatcctgctctccagcctgctgaagaacgacgtccccctcgccgggccgctgatcgccggcggcatgctgatcgcctgctacgtgatcagcgggtccagcgccgacctctccctggagaaggcggccgaggtgagctgggagcaggaggccgagcactccggcaccagccacaacatcctggtcgaggtgcaggacgacgggaccatgaagatcaaggacgaggagaaggacgacacgctcaccatcctgctgaaggccaccctcctggccgtgtccggcgtctaccccatgagcatccccgcgaccctgttcgtgtggtacttctggcagaagaagaagcagcggtccggggtgctctgggacacgcccagcccgcccgaggtcgagcgcgccgtgctggacgacggcatctaccggatcctgcagcgcggcctgctcgggcggtcccaggtgggcgtcggggtgttccaggacggcgtgttccacaccatgtggcacgtcacccgcggggccgtgctgatgtaccagggcaagcggctggagcccagctgggcctccgtgaagaaggacctcatcagctacggcgggggctggcgcttccaggggtcctggaacaccggcgaggaggtccaggtgatcgccgtggagcccgggaagaacccgaagaacgtccagacgacccccggcaccttcaagacccccgagggcgaggtgggggcgatcgccctggacttcaagcccggcacgagcgggtccccgatcgtgaaccgggagggcaagatcgtcggcctgtacgggaacggcgtggtgaccaccagcgggacctacgtctccgccatcgcccaggccaaggcgagccaggagggccccctccccgagatcgaggacgaggtgttcaagaagcgcaacctgacgatcatggacctgcacccggggagcggcaagacccggcgctacctccccgccatcgtgcgggaggccatcaagcgcaagctgcggaccctgatcctcgcccccacccgcgtcgtggcgtccgagatggccgaggccctgaagggcatgcccatccgctaccagacgaccgccgtcaagagcgagcacaccgggcgggagatcgtcgacctgatgtgccacgccaccttcacgatgcgcctcctgtccccggtgcgggtgcccaactacaacatgatcatcatggacgaggcgcacttcaccgaccccgccagcatcgccgcccgcggctacatctccacccgggtcgggatgggcgaggccgcggccatcttcatgaccgccacgcccccggggagcgtggaggccttcccccagtccaacgccgtgatccaggacgaggagcgcgacatccccgagcggagctggaactccggctacgactggatcaccgacttccccggcaagaccgtctggttcgtgccgagcatcaagtccgggaacgacatcgcgaactgcctgcgcaagaacggcaagcgggtgatccagctcagccgcaagaccttcgacacggagtaccagaagaccaagaacaacgactgggactacgtcgtgaccaccgacatctccgagatgggggccaacttccgggccgaccgcgtgatcgacccccggcgctgcctgaagcccgtcatcctgaaggacggccccgagcgggtgatcctcgccgggccgatgcccgtgacggtcgcgagcgccgcccagcgccggggccgcatcggccggaaccagaacaaggagggggaccagtacgtgtacatgggccagcccctgaacaacgacgaggaccacgcccactggaccgaggccaagatgctgctcgacaacatcaacacccccgaggggatcatcccggcgctgttcgagcccgagcgcgagaagtccgccgccatcgacggcgagtaccgcctgcgcggggaggcccgcaagaccttcgtcgagctcatgcggcgcggcgacctgcccgtgtggctgagctacaaggtggcctccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcgcggacgtactccgacccgctcgccctgcgcgagttcaaggagttcgccgccgggcggcgcagcgtgagcggcgacctgatcctcgagatcggcaagctgccccagcacctgaccctccgggcccagaacgcgctggacaacctggtcatgctccacaactccgagcagggcgggaaggcctaccgccacgccatggaggagctgcccgacaccatcgagaccctgatgctcctggccctgatcgcggtgctcaccggcggggtgaccctgttcttcctgagcgggaaggggctcggcaagacctccatcgggctgctgtgcgtcaccgccagctccgccctcctgtggatggccagcgtggagccccactggatcgccgcgtccatcatcctggagttcttcctcatggtgctgctgatcccggagcccgaccggcagcgcacgccccaggacaaccagctcgcctacgtcgtgatcggcctgctgttcatgatcctcaccgtggccgccaacgagatggggctgctggagaccaccaagcgggacctcggcatcgggcacgtcgccgcggagaaccaccagcacgccacgatgctggacgtggacctgcgcccggccagcgcctggaccctctacgccgtggcgaccaccgtcatcacgcccatgatgcggcacaccatcgagaacaccaccgccaacatctccctgacggccatcgccaaccaggccgcgatcctgatgggcctcgacaagggctggcccatcagcaagatggacatcggggtgcccctgctggccctcggctgctactcccaggtgaacccgctgaccctgaccgccgccgtcctcatgctggtggcgcactacgccatcatcgggcccggcctgcaggccaaggccacccgcgaggcccagaagcgcacggcggccgggatcatgaagaaccccaccgtggacggcatcgtcgccatcgacctcgaccccgtggtgtacgacgccaagttcgagaagcagctgggccagatcatgctgctcatcctgtgcaccagccagatcctgctcatgcggaccacgtgggccctgtgcgagtccatcaccctggcgaccgggccgctcaccacgctgtgggagggcagccccgggaagttctggaacaccaccatcgccgtctccatggccaacatcttccgcggcagctacctggccggcgccgggctcgcgttctccctgatgaagtccctgggcgggggccggcgcgggaccggcgcccagggcgagacgctcggggagaagtggaagcggcagctgaaccagctgtccaagagcgagttcaacacctacaagcgcagcggcatcatggaggtggaccggtccgaggccaaggaggggctcaagcgcggcgagaccaccaagcacgccgtgagccgggggaccgcgaagctgcgctggttcgtcgagcggaacctggtgaagcccgagggcaaggtgatcgacctgggctgcgggcgcggcgggtggtcctactactgcgccggcctcaagaaggtcacggaggtgaaggggtacaccaagggcggccccgggcacgaggagccgatccccatggccacctacggctggaacctggtgaagctgcacagcgggaaggacgtcttcttcatgccgcccgagaagtgcgacaccctcctgtgcgacatcggcgagtccagcccgaaccccacgatcgaggaggggcggaccctgcgcgtgctcaagatggtggagccctggctgcggggcaaccagttctgcatcaagatcctgaacccctacatgccgtccgtcgtggagaccctcgagcagatgcagcgcaagcacggcgggatgctggtgcggaaccccctgagccgcaactccacccacgagatgtactgggtcagctgcggcacggggaacatcgtgtccgccgtgaacatgaccagccggatgctcctgaaccgcttcaccatggcccaccgcaagcccacctacgagcgggacgtcgacctgggcgcgggcacgcgccacgtggccgtggagcccgaggtcgccaacctcgacatcatcgggcagcggatcgagaacatcaagaacgagcacaagtccacctggcactacgacgaggacaacccgtacaagacctgggcctaccacggcagctacgaggtgaagccctccgggagcgcctccagcatggtgaacggcgtcgtgcgcctgctgaccaagccctgggacgtcatccccatggtgacgcagatcgcgatgaccgacaccaccccgttcgggcagcagcgggtgttcaaggagaaggtcgacacgcgcacgccccgggccaagcgcggcaccacccagatcatggaggtgacggccaagtggctctggggcttcctgtcccggaacaagaagccccgcatctgcacccgggaggagttcacccgcaaggtgcggagcaacgccgccatcggggcggtcttcgtggacgagaaccagtggaacagcgccaaggaggccgtggaggacgagcgcttctgggacctggtccaccgggagcgcgagctccacaagcagggcaagtgcgcgacctgcgtgtacaacatgatggggaagcgggagaagaagctgggcgagttcgggaaggcgaagggctcccgcgccatctggtacatgtggctgggcgcccggttcctcgagttcgaggccctggggttcatgaacgaggaccactggttcagccgcgagaactccctgagcggcgtggagggggagggcctccacaagctggggtacatcctgcgggacatctccaagatcccgggcggcaacatgtacgccgacgacacggcggggtgggacacccgcatcaccgaggacgacctccagaacgaggccaagatcaccgacatcatggagcccgagcacgccctgctggccacgagcatcttcaagctcacctaccagaacaaggtcgtgcgcgtgcagcggcccgccaagaacggcaccgtcatggacgtgatctcccgccgggaccagcgcgggagcggccaggtgggcacctacgggctgaacacgttcaccaacatggaggtccagctgatccggcagatggagtccgagggcatcttcctccccagcgagctggagaccccgaacctggcggagcgcgtgctcgactggctggagaagcacggggccgagcggctgaagcgcatggccatctccggcgacgactgcgtggtcaagcccatcgacgaccggttcgccaccgccctcaccgcgctgaacgacatggggaaggtgcgcaaggacatcccccagtgggagcccagcaagggctggaacgactggcagcaggtcccgttctgctcccaccacttccaccagctgatcatgaaggacggccgggagatcgtcgtgccctgccgcaaccaggacgagctcgtggggcgggcccgcgtcagccagggcgccgggtggtccctgcgggagacggcctgcctgggcaagagctacgcccagatgtggcagctcatgtacttccaccgccgggacctgcgcctggcggccaacgccatctgctccgccgtgcccgtggactgggtccccaccagccggaccacctggagcatccacgcgcaccaccagtggatgacgaccgaggacatgctctccgtgtggaaccgcgtgtggatcgaggagaacccgtggatggaggacaagacccacgtcagctcctgggaggaggtgccctacctggggaagcgcgaggaccagtggtgcggcagcctgatcggcctcaccgcccgggccacgtgggccaccaacatccaggtggccatcaaccaggtccgccggctgatcgggaacgagaactacctggactacatgacctccatgaagcgcttcaagaacgagagcgaccccgagggcgcgctctggtga

SEQ ID NO: 8276 - RNA, 9879 nt, synthetic construct
  misc_feature 1..9879: note = derived and/or modified CDS sequence (opt1) from DENV-1__GU131838__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctgtggtccaacggggtgctcgagagcgagatgatcatccccaagatctacggcgggccgatctcccagcacaactaccggcccggctacttcacccagaccgccgggccctggcacctgggcaagctggagctcgacttcgacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgtgagcatcatgatcgaggaggtgatgcggtcccgctggagccgcaagatgctgatgaccgggacgctcgccgtcttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtggggctcctgttccgccggctgaccagccgcgaggtcctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatggtgctcagcatcgtctccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggccatcgggatcgtgagcatcctgctgtccagcctcctgaagaacgacgtccccctggcgggcccgctcatcgccggcgggatgctgatcgcctgctacgtgatcagcggctccagcgccgacctgtccctcgagaagacggccgaggtgagctgggagcaggaggcggagcactccggggccagccacaacatcctggtcgaggtgcaggacgacggcaccatgaagatcaaggacgaggagcgcgacgacaccctgaccatcctcctgaaggccacgctgctcgccgtgtccggggtctaccccatgagcatccccgccaccctgttcgtgtggtacttctggcagaagaagaagcagcggtccggcgtgctgtgggacacccccagcccgcccgaggtcgagcgcgcggtgctcgacgacggcatctaccggatcctgcagcgcgggctgctgggccggtcccaggtgggggtcggcgtgttccaggacggggtgttccacaccatgtggcacgtcacgcgcggcgccgtgctcatgtaccagggcaagcggctggagcccagctgggcctccgtgaagaaggacctgatcagctacgggggcgggtggcgcttccagggctcctggaacaccggggaggaggtccaggtgatcgccgtggagcccggcaagaacccgaagaacgtccagaccacccccggcacgttcaagacccccgagggggaggtgggcgccatcgcgctcgacttcaagcccgggaccagcggctccccgatcgtgaaccgggagggcaagatcgtcgggctgtacggcaacggggtggtgaccacgagcggcacctacgtctccgccatcgcccaggccaaggccagccaggaggggcccctgcccgagatcgaggacgaggtgttcaagaagcgcaacctcaccatcatggacctgcacccgggcagcggcaagacccggcgctacctgcccgcgatcgtgcgggaggccatcaagcgcaagctccgcacgctgatcctggcccccacccgggtcgtggcctccgagatggcggaggccctcaaggggatgcccatccgctaccagaccaccgccgtcaagagcgagcacacgggccgggagatcgtcgacctgatgtgccacgccaccttcaccatgcgcctgctctccccggtgcgggtgcccaactacaacatgatcatcatggacgaggcccacttcaccgaccccgcgagcatcgccgcccgcgggtacatctccacgcgggtcggcatgggggaggccgccgcgatcttcatgaccgccacgccgcccggcagcgtggaggccttcccccagtccaacgccgtgatccaggacgaggagcgcgacatccccgagcggagctggaactccggctacgactggatcaccgacttccccgggaagacggtctggttcgtgcccagcatcaagtccggcaacgacatcgccaactgcctgcgcaagaacgggaagcgggtgatccagctgagccgcaagaccttcgacaccgagtaccagaagaccaagaacaacgactgggactacgtcgtgacgaccgacatctccgagatgggcgcgaacttccgggccgaccgcgtgatcgacccccggcgctgcctcaagcccgtcatcctgaaggacgggcccgagcgggtgatcctggccggcccgatgcccgtcaccgtggccagcgcggcccagcgccggggccgcatcgggcgcaaccagaacaaggagggcgaccagtacgtgtacatggggcagcccctcaacaacgacgaggaccacgcccactggaccgaggccaagatgctgctggacaacatcaacacgcccgagggcatcatcccggccctcttcgagcccgagcgggagaagtccgcggccatcgacggggagtaccgcctgcggggcgaggcccgcaagaccttcgtcgagctgatgcggcgcggcgacctccccgtgtggctgagctacaaggtggcctccgaggggttccagtacagcgaccggcgctggtgcttcgacggcgagcggaacaaccaggtcctggaggagaacatggacgtggagatctggaccaaggagggggagcgcaagaagctccggccccgctggctggacgcccggacctactccgacccgctggcgctccgcgagttcaaggagttcgccgccggccggcgcagcgtgagcggcgacctgatcctggagatcgggaagctcccccagcacctgaccctgcgggcccagaacgccctcgacaacctggtcatgctgcacaactccgagcagggcgggaaggcgtaccgccacgccatggaggagctccccgacacgatcgagaccctgatgctgctcgccctgatcgccgtgctgaccggcggggtgaccctcttcttcctgagcggcaagggcctggggaagacgtccatcggcctcctgtgcgtcaccgcgagctccgccctgctctggatggccagcgtggagccccactggatcgccgcctccatcatcctggagttcttcctgatggtgctcctgatcccggagcccgaccggcagcgcacgccccaggacaaccagctggcgtacgtcgtgatcgggctcctgttcatgatcctgaccgtggccgccaacgagatgggcctcctggagacgaccaagaaggacctggggatcggctacgtcgccgccgagaaccaccagcacgcgaccatgctcgacgtggacctgcacccggccagcgcctggaccctgtacgccgtggccacgaccgtcatcacccccatgatgcggcacaccatcgagaacacgaccgcgaacatctccctcaccgccatcgccaaccaggccgccatcctgatgggcctggacaaggggtggcccatcagcaagatggacatcggcgtgcccctcctggcgctggggtgctactcccaggtgaacccgctcaccctgacggccgccgtcctgatgctcgtggcccactacgcgatcatcggccccgggctgcaggccaaggccacccgcgaggcccagaagcgcaccgccgcgggcatcatgaagaaccccaccgtggacggcatcgtcgccatcgacctggaccccgtggtgtacgacgccaagttcgagaagcagctcgggcagatcatgctgctgatcctctgcacgagccagatcctgctgatgcggaccacctgggccctctgcgagtccatcaccctggccacgggcccgctgaccaccctctgggaggggagccccggcaagttctggaacaccacgatcgcggtctccatggccaacatcttccgcggcagctacctggccggggccggcctggccttctccctcatgaagtccctcgggggcgggcggcgcgggaccggcgcgcagggggagaccctgggcgagaagtggaagcggcagctcaaccagctgtccaagagcgagttcaacacctacaagcgcagcgggatcatggaggtggaccggtccgaggccaaggagggcctgaagcgcggggagacgaccaagcacgccgtgagccggggcaccgccaagctccgctggttcgtcgagcggaacctggtgaagcccgagggcaaggtgatcgacctggggtgcggccgcgggggctggtcctactactgcgcggggctgaagaaggtcaccgaggtgaagggctacaccaagggcgggcccggccacgaggagccgatccccatggccacgtacgggtggaacctcgtgaagctgcacagcggcaaggacgtcttcttcatgccgcccgagaagtgcgacaccctgctctgcgacatcggggagtccagcccgaaccccaccatcgaggagggccggaccctgcgcgtgctgaagatggtggagccctggctccggggcaaccagttctgcatcaagatcctgaacccctacatgccgtccgtcgtggagacgctggagcagatgcagcgcaagcacgggggcatgctcgtgcggaaccccctgagccgcaactccacccacgagatgtactgggtcagctgcgggaccggcaacatcgtgtccgccgtgaacatgaccagccggatgctgctcaaccgcttcacgatggcccaccgcaagcccacctacgagcgggacgtcgacctgggcgccgggacccgccacgtggcggtggagcccgaggtcgccaacctggacatcatcggccagcggatcgagaacatcaagaacgagcacaagtccacctggcactacgacgaggacaacccgtacaagacgtgggcctaccacgggagctacgaggtgaagccctccggcagcgcctccagcatggtcaacggggtggtgcgcctcctgaccaagccctgggacgtcatccccatggtgacccagatcgccatgaccgacacgaccccgttcggccagcagcgggtgttcaaggagaaggtcgacacccgcacgccccgggcgaagcgcggcacgacccagatcatggaggtgaccgccaagtggctgtgggggttcctctcccggaacaagaagccccgcatctgcacccgggaggagttcacgcgcaaggtgcggagcaacgccgccatcggcgccgtcttcgtggacgagaaccagtggaacagcgcgaaggaggccgtggaggacgagcgcttctgggacctggtccaccgggagcgcgagctgcacaagcaggggaagtgcgcgacctgcgtgtacaacatgatgggcaagcgggagaagaagctcggggagttcggcaaggccaagggctcccgcgcgatctggtacatgtggctgggggcccggttcctggagttcgaggccctcggcttcatgaacgaggaccactggttcagccgcgagaactccctgagcggggtggagggcgaggggctgcacaagctcggctacatcctgcgggacatctccaagatcccgggcgggaacatgtacgccgacgacaccgccggctgggacacccgcatcacggaggacgacctgcagaacgaggcgaagatcaccgacatcatggagcccgagcacgccctcctggccaccagcatcttcaagctgacctaccagaacaaggtcgtgcgcgtgcagcggcccgccaagaacgggacggtcatggacgtgatctcccgccgggaccagcgcggcagcggccaggtggggacctacggcctcaacaccttcaccaacatggaggtccagctgatccggcagatggagtccgaggggatcttcctgcccagcgagctcgagacgccgaacctggccgagcgcgcgctggactggctcgagaagcacggcgccgagcggctgaagcgcatggccatctccggggacgactgcgtggtgaagcccatcgacgaccggttcgccaccgccctgaccgcgctcaacgacatgggcaaggtccgcaaggacatcccccagtgggagcccagcaagggctggaacgactggcagcaggtcccgttctgctcccaccacttccaccagctgatcatgaaggacgggcgggagatcgtggtcccctgccgcaaccaggacgagctggtgggccgggcccgcgtgagccagggggccggctggtccctccgggagaccgcctgcctgggcaagagctacgcccagatgtggcagctgatgtacttccaccgccgggacctccgcctggcggccaacgccatctgctccgccgtccccgtggactgggtgcccaccagccggacgacctggagcatccacgcgcaccaccagtggatgaccaccgaggacatgctgtccgtctggaaccgcgtgtggatcgaggagaacccgtggatggaggacaagacgcacgtgagctcctgggaggaggtcccctacctcggcaagcgcgaggaccagtggtgcggcagcctgatcgggctgaccgcccgggccacctgggccaccaacatccaggtggccatcaaccaggtgcgccggctcatcggcaacgagaactacctggactacatgacgtccatgaagcgcttcaagaacgagagcgaccccgagggggcgctgtggtga

SEQ ID NO: 8277 - RNA, 9879 nt, synthetic construct
  misc_feature 1..9879: note = derived and/or modified CDS sequence (opt1) from DENV-1__GU131839__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagacctccgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagaccgtccagtacgagaacctcaagtactccgtgatcgtgaccgtccacacgggcgaccagcaccaggtggggaacgagaccaccgagcacggcaccatcgcgaccatcacgccccaggcccccaccagcgagatccagctgaccgactacggggccctgaccctcgactgcagcccccggacgggcctggacttcaacgagatggtcctgctcaccatgaaggagaagtcctggctggtgcacaagcagtggttcctggacctcccgctgccctggacctccggggccagcaccagccaggagacgtggaaccggcaggacctgctcgtgaccttcaagaccgcccacgcgaagaagcaggaggtcgtggtgctgggctcccaggagggcgccatgcacaccgccctgacgggggccaccgagatccagaccagcggcaccacgaccatcttcgccgggcacctcaagtgccgcctgaagatggacaagctgaccctcaagggcatgtcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccggctgatcaccgccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccacggcccgcggggcgcgccgcatggccatcctgggcgacaccgcgtgggacttcgggagcatcggcggcgtgttcacctccgtggggaagctcgtccaccaggtgttcggcaccgcctacggggtgctgttcagcggcgtctcctggacgatgaagatcgggatcggcatcctgctcacctggctgggcctgaacagccggtccaccagcctctccatgacctgcatcgccgtggggatggtgacgctgtacctgggcgtcatggtgcaggccgacagcgggtgcgtgatcaactggaagggccgcgagctcaagtgcgggtccggcatcttcgtcaccaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcacggtcgtggtgggggacgccaacggcatcctcgtccaggggaagaagatgatccgcccccagcccatggagcacaagtactcctggaagtcctggggcaaggcgaagatcatcggcgccgacacccagaacaccaccttcatcatcgacgggcccgacacgccggagtgccccgacggccagcgggcctggaacatctgggaggtggaggactacgggttcggcgtgttcaccaccaacatctggctgaagctgcgcgactcctacacccagatgtgcgaccaccggctcatgagcgccgcgatcaaggactccaaggccgtccacgccgacatgggctactggatcgagagcgagaagaacgagacgtggaagctggcccgcgcctccttcatcgaggtgaagacctgcacctggcccaagagccacaccctgtggtccaacggggtgctcgagagcgagatgatcatccccaagatctacggcgggccgatctcccagcacaactaccggcccggctacttcacgcagaccgcggggccctggcacctgggcaagctggagctcgacttcgacctgtgcgagggcaccaccgtcgtggtggacgagcactgcgggaaccgcggcccgagcctgcggacgaccaccgtcaccgggaagatcatccacgagtggtgctgccgctcctgcacgctgccgcccctgcggttccgcggcgaggacgggtgctggtacggcatggagatccggcccgtgaaggagaaggaggagaacctggtgcgcagcatggtctccgccggcagcggggaggtggacagcttctccctcggcatcctgtgcgtgagcatcatgatcgaggaggtcatgcggtcccgctggagccgcaagatgctgatgaccgggaccctcgccgtgttcctgctgctcatcatgggccagctgacctggaacgacctgatccggctctgcatcatggtgggggccaacgcctccgaccgcatgggcatgggcacgacctacctggcgctgatggccaccttcaagatgcggccgatgttcgccgtcgggctcctgttccgccggctgaccagccgcgaggtgctcctgctgacgatcggcctctccctggtcgccagcgtggagctgcccaactccctcgaggagctgggggacggcctggccatgggcatcatgatgctcaagctgctgaccgagttccagccccaccagctctggaccaccctgctgagcctcacgttcgtgaagaccgcgctgtccctggactacgcctggaagaccaccgccatggtcctcagcatcgtgtccctgttccccctgtgcctcagcacgacctcccagaagaccacctggctgccggtgctgctcgggagcttcggctgcaagcccctgaccatgttcctgatcacggagaacaagatctgggggcggaagtcctggcccctcaacgagggcatcatggccatcgggatcgtcagcatcctgctgtccagcctcctgaagaacgacgtgcccctggcgggcccgctcatcgccggcgggatgctgatcgcctgctacgtgatcagcggctccagcgccgacctgtccctcgagaaggccgcggaggtcagctgggagcaggaggccgagcactccggggccagccacaacatcctggtggaggtgcaggacgacggcaccatgaagatcaaggacgaggagcgcgacgacaccctgaccatcctcctgaaggccacgctgctcgccgtctccggggtgtaccccatgagcatccccgcgaccctgttcgtgtggtacttctggcagaagaagaagcagcggtccggcgtcctgtgggacacccccagcccgcccgaggtggagcgcgccgtgctcgacaacggcatctaccggatcctgcagcgcgggctgctgggccggtcccaggtcggggtgggcgtgttccaggacggggtcttccacaccatgtggcacgtgacgcgcggcgccgtgctcatgtaccagggcaagcggctggagcccagctgggcctccgtcaagaaggacctgatcagctacgggggcgggtggcgcttccagggctcctggaacaccggggaggaggtccaggtgatcgccgtcgagcccggcaagaacccgaagaacgtgcagaccacccccggcacgttcaagacccccgagggggaggtgggcgcgatcgccctcgacttcaagcccgggaccagcggctccccgatcgtcaaccgggagggcaagatcgtggggctgtacggcaacggggtggtcaccacgagcggcacctacgtgtccgccatcgcccaggccaaggcgagccaggaggggcccctgcccgagatcgaggacgaggtgttcaagaagcgcaacctcaccatcatggacctgcacccgggcagcggcaagacccggcgctacctgcccgccatcgtccgggaggccatcaagcgcaagctccgcacgctgatcctggcccccacccgggtggtggcgtccgagatggccgaggccctcaaggggatgcccatccgctaccagaccaccgccgtcaagagcgagcacacgggccgggagatcgtggacctgatgtgccacgccaccttcaccatgcgcctgctctccccggtgcgggtccccaactacaacatgatcatcatggacgaggcgcacttcaccgaccccgccagcatcgccgcccgcgggtacatctccacgcgggtgggcatgggggaggccgcggccatcttcatgaccgccacgccgcccggcagcgtggaggccttcccccagtccaacgccgtcatccaggacgaggagcgcgacatccccgagcggagctggaactccggctacgactggatcaccgacttccccgggaagacggtgtggttcgtgcccagcatcaagtccggcaacgacatcgcgaactgcctgcgcaagaacgggaagcgggtcatccagctgagccgcaagaccttcgacaccgagtaccagaagaccaagaacaacgactgggactacgtggtgacgaccgacatctccgagatgggcgccaacttccgggccgaccgcgtcatcgacccccggcgctgcctcaagcccgtgatcctgaaggacgggcccgagcgggtcatcctggccggcccgatgcccgtgaccgtggcgagcgccgcccagcgccggggccgcatcgggcgcaaccagaacaaggagggcgaccagtacgtctacatggggcagcccctcaacaacgacgaggaccacgcccactggaccgaggccaagatgctgctggacaacatcaacacgcccgagggcatcatcccggccctcttcgagcccgagcgggagaagtccgccgccatcgacggggagtaccgcctgcggggcgaggcccgcaagaccttcgtggagctgatgcggcgcggcgacctccccgtgtggctgagctacaaggtcgcctccgaggggttccagtacagcgaccggcgctggtgcttcgacggcgagcggaacaaccaggtgctggaggagaacatggacgtggagatctggaccaaggagggggagcgcaagaagctccggccccgctggctggacgcgcggacctactccgacccgctggccctccgcgagttcaaggagttcgccgccggccggcgcagcgtcagcggcgacctgatcctggagatcgggaagctcccccagcacctgaccctgcgggcccagaacgcgctcgacaacctggtgatgctgcacaactccgagcagggcgggaaggcctaccgccacgccatggaggagctccccgacacgatcgagaccctgatgctgctcgccctgatcgcggtgctgaccggcggggtcaccctcttcttcctgagcggcaagggcctggggaagacgtccatcggcctcctgtgcgtgaccgccagctccgccctgctctggatggccagcgtggagccccactggatcgccgcgtccatcatcctggagttcttcctgatggtcctcctgatcccggagcccgaccggcagcgcacgccccaggacaaccagctggcctacgtggtgatcgggctcctgttcatgatcctgaccgtcgccgccaacgagatgggcctcctggagacgaccaagaaggacctggggatcggctacgtggccgcggagaaccaccagcacgccaccatgctcgacgtggacctgcacccggccagcgcctggaccctgtacgccgtcgcgacgaccgtgatcacccccatgatgcggcacaccatcgagaacacgaccgccaacatctccctcaccgccatcgccaaccaggccgcgatcctgatgggcctggacaaggggtggcccatcagcaagatggacatcggcgtgcccctcctggccctggggtgctactcccaggtcaacccgctcaccctgacgagcgccgtgctgatgctcgtggcccactacgcgatcatcggccccgggctgcaggccaaggccacccgcgaggcccagaagcgcaccgccgcgggcatcatgaagaaccccaccgtcgacggcatcgtggccatcgacctggaccccgtggtctacgacgccaagttcgagaagcagctcgggcagatcatgctgctgatcctctgcacgtcccagatcctgctgatgcggaccacctgggccctctgcgagagcatcaccctggccacgggcccgctgaccaccctctgggaggggtcccccggcaagttctggaacaccacgatcgcggtgagcatggccaacatcttccgcggctcctacctggccggggccggcctggccttcagcctcatgaagtccctcgggggcgggcggcgcggcaccggcgcgcagggggagaccctgggcgagaagtggaagcggcagctcaaccagctgagcaagagcgagttcaacacctacaagcgctccgggatcatggaggtggaccggagcgaggccaaggagggcctgaagcgcggggagacgaccaagcacgccgtctcccggggcaccgccaagctccgctggttcgtggagcggaacctggtgaagcccgagggcaaggtcatcgacctggggtgcggccgcgggggctggagctactactgcgcggggctgaagaaggtgaccgaggtgaagggctacaccaagggcgggcccggccacgaggagccgatccccatggccacgtacgggtggaacctcgtcaagctgcactccggcaaggacgtgttcttcatgccgcccgagaagtgcgacaccctgctctgcgacatcggggagagctccccgaaccccaccatcgaggagggccggaccctgcgcgtgctgaagatggtcgagccctggctccggggcaaccagttctgcatcaagatcctgaacccctacatgccgagcgtggtggagacgctggagcagatgcagcgcaagcacgggggcatgctcgtccggaaccccctgtcccgcaacagcacccacgagatgtactgggtgtcctgcgggaccggcaacatcgtgagcgccgtcaacatgacctcccggatgctgctcaaccgcttcacgatggcccaccgcaagcccacctacgagcgggacgtggacctgggcgccgggacccgccacgtggcggtcgagcccgaggtggccaacctggacatcatcggccagcggatcgagaacatcaagaacgagcacaagagcacctggcactacgacgaggacaacccgtacaagacgtgggcctaccacgggtcctacgaggtcaagcccagcggctccgccagctccatggtgaacggggtggtccgcctcctgaccaagccctgggacgtgatccccatggtgacccagatcgccatgaccgacacgaccccgttcggccagcagcgggtcttccgcgagaaggtggacacccggacgccccgcgcgaagcggggcacgacccagatcatggaggtgaccgccaagtggctgtgggggttcctcagccgcaacaagaagccccggatctgcacccgcgaggagttcacgcggaaggtccgcagcaacgccgccatcggcgccgtgttcgtggacgagaaccagtggaactccgcgaaggaggccgtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaagggcagccgggcgatctggtacatgtggctgggggcccgcttcctggagttcgaggccctcggcttcatgaacgaggaccactggttctcccgggagaacagcctgtccggggtcgagggcgaggggctgcacaagctcggctacatcctgcgcgacatcagcaagatcccgggcgggaacgtgtacgccgacgacaccgccggctgggacacccgcatcacggaggacgacctgcagaacgaggcgaagatcaccgacatcatggagcccgagcacgccctcctggccacctccatcttcaagctgacctaccagaacaaggtggtccgggtgcagcgccccgccaagaacgggacggtgatggacgtcatcagccggcgcgaccagcggggctccggccaggtggggacctacggcctcaacaccttcaccaacatggaggtgcagctgatccgccagatggagagcgaggggatcttcctgccctccgagctcgagacgccgaacctggccgagcgggcgctggactggctcgagaagcacggcgtcgagcgcctgaagcggatggccatcagcggggacgactgcgtggtgaagcccatcgacgaccgcttcgccaccgccctgaccgccctcaacgacatgggcaaggtccggaaggacatcccccagtgggagccctccaagggctggaacgactggcagcaggtcccgttctgcagccaccacttccaccagctgatcatgaaggacgggcgcgagatcgtggtcccctgccggaaccaggacgagctggtgggccgcgcgcgggtgtcccagggggccggctggagcctccgcgagaccgcctgcctggggaagtcctacgcccagatgtggcagctgatgtacttccaccggcgcgacctccggctggccgcgaacgccatctgcagcgccgtccccgtggactgggtgcccaccagccgcacgacctggtccatccacgcccaccaccagtggatgaccaccgaggacatgctgagcgtctggaaccgcgtgtggatcgaggagaacccgtggatggaggacaagacgcacgtgtccagctgggaggaggtcccctacctcggcaagcgggaggaccagtggtgcggctccctgatcgggctgaccgcgcgcgccacctgggccaccaacatccaggtggccatcaaccaggtgcggcgcctcatcggcaacgagaactacctggactacatgacgagcatgaagcggttcaagaacgagtccgacagcgagggggccctgtggtga

SEQ ID NO: 8278 - RNA, 9879 nt, synthetic construct
  misc_feature 1..9879: note = derived and/or modified CDS sequence (opt1) from DENV-1__GU131841__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgtgggggtgaacatgtgcaccctgatcgcgatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtcggcctggggctcgagacccgcaccgagacctggatgagctccgagggcgcctggaagcagatccagcgggtggagacctgggccctgcgccaccccgggttcacggtgatcgccttcttcctggcctacgcgatcggcaccagcatcacccagaaggggatcatcttcatcctcctgatgctggtgaccccctccatggccatgcggtgcgtgggcatcggcaaccgcgacttcgtggaggggctcagcggcgccacgtgggtcgacgtggtgctggagcacgggtcctgcgtcaccaccatggccaagaacaagcccaccctggacatcgagctcctgaagacggaggtgaccaaccccgccgtgctgcggaagctctgcatcgaggcgaagatcagcaacaccaccacggactcccgctgcccgacccagggcgaggccaccctggtcgaggagcaggacgccaacttcgtgtgccggcgcaccttcgtggaccggggctgggggaacggctgcgggctgttcggcaaggggagcctcctgacgtgcgccaagttcaagtgcgtcaccaagctggagggcaagatcgtgcagtacgagaacctcaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctgaccctcgactgcagcccccggaccggcctggacttcaacgagatggtgctgctcacgatgaaggagaagtcctggctggtgcacaagcagtggttcctggacctcccgctgccctggacctccggggccagcaccagccaggagacctggaaccggcaggacctgctcgtcacgttcaagaccgcccacgccaagaagcaggaggtggtggtcctgggctcccaggagggcgcgatgcacaccgccctgaccggggccacggagatccagaccagcggcaccaccacgatcttcgccgggcacctcaagtgccgcctgaagatggacaagctgaccctcaagggcatgtcctacgtgatgtgcaccgggagcttcaagctggagaaggaggtggccgagacccagcacggcacggtcctggtccaggtgaagtacgagggcaccgacgcgccctgcaagatccccttctccacccaggacgagaagggggtcacccagaacggccggctgatcacggccaacccgatcgtgaccgacaaggagaagcccgtgaacatcgagaccgagccgcccttcggggagagctacatcgtcgtgggcgccggcgagaaggccctcaagctgtcctggttcaagcgcgggagctccatcggcaagatgttcgaggcgaccgcccgcggggcccgccgcatggccatcctgggcgacacggcctgggacttcgggagcatcggcggcgtgttcacctccgtcgggaagctcgtgcaccaggtgttcggcaccgcgtacggggtcctgttcagcggcgtgtcctggaccatgaagatcgggatcggcatcctgctcacgtggctgggcctgaacagccggtccaccagcctctccatgacctgcatcgccgtggggatggtcaccctgtacctgggcgtgatggtgcaggccgacagcgggtgcgtcatcaactggaagggccgcgagctcaagtgcgggtccggcatcttcgtgacgaacgaggtgcacacctggaccgagcagtacaagttccaggccgacagcccgaagcggctgagcgccgcgatcggcaaggcctgggaggagggggtctgcggcatccgctccgccacccggctggagaacatcatgtggaagcagatcagcaacgagctcaaccacatcctgctggagaacgacatgaagttcaccgtggtggtcggggacgccaacggcatcctcgcccaggggaagaagatgatccgcccccagcccatggagcacaagtactcctggaagtcctggggcaaggcgaagatcatcggcgccgacatccagaacacgaccttcatcatcgacgggcccgacaccccggagtgccccgacggccagcgggcctggaacatctgggaggtggaggactacgggttcggcgtgttcaccacgaacatctggctgaagctgcgcgactcctacacccagatgtgcgaccaccggctcatgagcgccgcgatcaaggactccaaggccgtccacgccgacatgggctactggatcgagagcgagaagaacgagacctggaagctggcccgcgcctccttcatcgaggtgaagacctgcacgtggcccaagagccacaccctgtggtccaacggggtgctcgagagcgagatgatcatccccaagatctacggcgggccgatctcccagcacaactaccggcccggctacttcacccagaccgcggggccctggcacctgggcaagctggagctcgacttcgacctgtgcgagggcacgaccgtcgtggtggacgagcactgcgggaaccgcggcccgagcctgcggaccaccacggtcaccgggaagatcatccacgagtggtgctgccgctcctgcaccctgccgcccctgcggttccgcggcgaggacgggtgctggtacggcatggagatccggcccgtgaaggagaaggaggagaacctggtgcgcagcatggtctccgccggcagcggggaggtggacagcttctccctcggcatcctgtgcgtgagcatcatgatcgaggaggtcatgcggtcccgctggagccgcaagatgctgatgaccgggacgctcgccgtgttcctgctgctcatcatgggccagctgacctggaacgacctgatccggctctgcatcatggtgggggccaacgcctccgaccgcatgggcatgggcaccacctacctggcgctgatggccacgttcaagatgcggccgatgttcgccgtcgggctcctgttccgccggctgaccagccgcgaggtgctcctgctgaccatcggcctctccctggtcgccagcgtggagctgcccaactccctcgaggagctgggggacggcctggccatgggcatcatgatgctcaagctgctgaccgagttccagccccaccagctctggacgaccctgctgagcctcaccttcgtgaagaccacgctgtccctggactacgcgtggaagaccaccgccatggtcctcagcatcgtgtccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggccatcgggatcgtcagcatcctgctgtccagcctcctgaagaacgacgtgcccctggccggcccgctcatcgcgggcgggatgctgatcgcctgctacgtgatcagcggctccagcgccgacctgtccctcgagaaggccgccgaggtcagctgggagcaggaggcggagcactccggggccagccacaacatcctggtggaggtgcaggacgacggcacgatgaagatcaaggacgaggagcgcgacgacaccctgaccatcctcctgaaggccaccctgctcgccgtctccggggtgtaccccatgagcatccccgccacgctgttcgtgtggtacttctggcagaagaagaagcagcggtccggcgtcctgtgggacacccccagcccgcccgaggtggagcgcgcggtgctcgacgacggcatctaccggatcctgcagcgcgggctgctgggccggtcccaggtcggggtgggcgtgttccaggacggggtcttccacaccatgtggcacgtgacccgcggcgccgtgctcatgtaccagggcaagcggctggagcccagctgggcctccgtcaagaaggacctgatcagctacgggggcgggtggcgcttccagggctcctggaacacgggggaggaggtccaggtgatcgccgtcgagcccggcaagaacccgaagaacgtgcagaccacccccggcaccttcaagacgcccgagggggaggtgggcgccatcgcgctcgacttcaagcccgggaccagcggctccccgatcgtcaaccgggagggcaagatcgtggggctgtacggcaacggggtggtcaccaccagcggcacgtacgtgtccgccatcgcccaggccaaggccagccaggaggggcccctgcccgagatcgaggacgaggtgttcaagaagcgcaacctcaccatcatggacctgcacccgggcagcggcaagacccggcgctacctgcccgcgatcgtccgggaggccatcaagcgcaagctccgcaccctgatcctggcccccacgcgggtggtggcctccgagatggcggaggccctcaaggggatgcccatccgctaccagaccaccgccgtcaagagcgagcacaccggccgggagatcgtggacctgatgtgccacgccacgttcaccatgcgcctgctctccccggtgcgggtccccaactacaacatgatcatcatggacgaggcccacttcaccgaccccgcgagcatcgccgcccgcgggtacatctccacccgggtgggcatgggggaggccgccgcgatcttcatgacggccacgccgcccggcagcgtggaggccttcccccagtccaacgccgtcatccaggacgaggagcgcgacatccccgagcggagctggaactccggctacgactggatcaccgacttccccgggaagaccgtgtggttcgtgcccagcatcaagtccggcaacgacatcgccaactgcctgcgcaagaacgggaagcgggtcatccagctgagccgcaagacgttcgacaccgagtaccagaagaccaagaacaacgactgggactacgtggtgaccacggacatctccgagatgggcgcgaacttccgggccgaccgcgtcatcgacccccggcgctgcctcaagcccgtgatcctgaaggacgggcccgagcgggtcatcctggccggcccgatgcccgtgaccgtggccagcgcggcccagcgccggggccgcatcgggcgcaaccagaacaaggagggcgaccagtacgtctacatggggcagcccctcaacaacgacgaggaccacgcccactggaccgaggccaagatgctgctggacaacatcaacacccccgagggcatcatcccggccctcttcgagcccgagcgggagaagtccgcggccatcgacggggagtaccgcctgcggggcgaggcccgcaagacgttcgtggagctgatgcggcgcggcgacctccccgtgtggctgagctacaaggtcgcctccgaggggttccagtacagcgaccggcgctggtgcttcgacggcgagcggaacaaccaggtgctggaggagaacatggacgtggagatctggaccaaggagggggagcgcaagaagctccggccccgctggctggacgcccggacctactccgacccgctggcgctccgcgagttcaaggagttcgccgccggccggcgcagcgtcagcggcgacctgatcctggagatcgggaagctcccccagcacctgaccctgcgggcccagaacgccctcgacaacctggtgatgctgcacaactccgagcagggcgggaaggcgtaccgccacgccatggaggagctccccgacaccatcgagacgctgatgctgctcgccctgatcgccgtgctgaccggcggggtcaccctcttcttcctgagcggcaagggcctggggaagacctccatcggcctcctgtgcgtgacggcgagctccgccctgctctggatggccagcgtggagccccactggatcgccgcctccatcatcctggagttcttcctgatggtcctcctgatcccggagcccgaccggcagcgcacgccccaggacaaccagctggcgtacgtggtgatcgggctcctgttcatgatcctgaccgtcgccgccaacgagatgggcctcctggagaccacgaagaaggacctggggatcggctacgtggccgccgagaaccaccagcacgcgaccatgctcgacgtggacctgcacccggccagcgcctggaccctgtacgccgtcgccaccacggtgatcacccccatgatgcggcacaccatcgagaacaccacggcgaacatctccctcaccgccatcgccaaccaggccgccatcctgatgggcctggacaaggggtggcccatcagcaagatggacatcggcgtgcccctcctggcgctggggtgctactcccaggtcaacccgctcaccctgaccgccgccgtgctgatgctcgtggcccactacgcgatcatcggccccgggctgcaggccaaggccacgcgcgaggcccagaagcgcaccgccgcgggcatcatgaagaaccccaccgtcgacggcatcgtggccatcgacctggaccccgtggtctacgacgccaagttcgagaagcagctcgggcagatcatgctgctgatcctctgcaccagccagatcctgctgatgcggacgacctgggccctctgcgagtccatcaccctggccaccggcccgctgacgaccctctgggaggggagccccggcaagttctggaacaccaccatcgcggtgtccatggccaacatcttccgcggcagctacctggccggggccggcctggccttctccctcatgaagtccctcgggggcgggcggcgcgggacgggcgcgcagggggagaccctgggcgagaagtggaagcggcagctcaaccagctgtccaagagcgagttcaacacctacaagcgcagcgggatcatggaggtggaccggtccgaggccaaggagggcctgaagcgcggggagaccacgaagcacgccgtcagccggggcaccgccaagctccgctggttcgtggagcggaacctggtgaagcccgagggcaaggtcatcgacctggggtgcggccgcgggggctggtcctactactgcgcggggctgaagaaggtgaccgaggtgaagggctacaccaagggcgggcccggccacgaggagccgatccccatggccacctacgggtggaacctcgtcaagctgcacagcggcaaggacgtgttcttcatgccgcccgagaagtgcgacacgctgctctgcgacatcggggagtccagcccgaaccccaccatcgaggagggccggaccctgcgcgtgctgaagatggtcgagccctggctccggggcaaccagttctgcatcaagatcctgaacccctacatgccgtccgtggtggagaccctggagcagatgcagcgcaagcacgggggcatgctcgtccggaaccccctgagccgcaactccacgcacgagatgtactgggtgagctgcgggaccggcaacatcgtgtccgccgtcaacatgaccagccggatgctgctcaaccgcttcaccatggcccaccgcaagcccacgtacgagcgggacgtggacctgggcgccgggacccgccacgtggcggtcgagcccgaggtggccaacctggacatcatcggccagcggatcgagaacatcaagaacgagcacaagtccacctggcactacgacgaggacaacccgtacaagacctgggcctaccacgggagctacgaggtcaagccctccggcagcgcctccagcatggtgaacggggtggtccgcctcctgacgaagccctgggacgtgatccccatggtgacccagatcgccatgaccgacaccacgccgttcggccagcagcgggtcttcaaggagaaggtggacacccgcacgccccgggcgaagcgcggcaccacgcagatcatggaggtgaccgccaagtggctgtgggggttcctctcccggaacaagaagccccgcatctgcacccgggaggagttcacccgcaaggtccggagcaacgccgccatcggcgccgtgttcgtggacgagaaccagtggaacagcgcgaaggaggccgtcgaggacgagcgcttctgggacctggtgcaccgggagcgcgagctgcacaagcaggggaagtgcgccacgtgcgtgtacaacatgatgggcaagcgggagaagaagctcggggagttcggcaaggccaagggctcccgcgcgatctggtacatgtggctgggggcccggttcctggagttcgaggccctcggcttcatgaacgaggaccactggttcagccgcgagaactccctgagcggggtcgagggcgaggggctgcacaagctcggctacatcctgcgggacatctccaagatcccgggcgggaacatgtacgccgacgacaccgccggctgggacacccgcatcaccgaggacgacctgcagaacgaggcgaagatcacggacatcatggagcccgagcacgccctcctggccaccagcatcttcaagctgacctaccagaacaaggtggtgcgcgtccagcggcccgccaagaacgggaccgtgatggacgtgatctcccgccgggaccagcgcggcagcggccaggtcgggacgtacggcctcaacaccttcaccaacatggaggtgcagctgatccggcagatggagtccgaggggatcttcctgcccagcgagctcgagaccccgaacctggccgagcgcgcgctggactggctcgagaagcacggcgccgagcggctgaagcgcatggccatctccggggacgactgcgtggtcaagcccatcgacgaccggttcgccacggccctgaccgcgctcaacgacatgggcaaggtgcgcaaggacatcccccagtgggagcccagcaagggctggaacgactggcagcaggtcccgttctgctcccaccacttccaccagctgatcatgaaggacgggcgggagatcgtcgtgccctgccgcaaccaggacgagctggtgggccgggcccgcgtcagccagggggccggctggtccctccgggagaccgcctgcctgggcaagagctacgcccagatgtggcagctgatgtacttccaccgccgggacctccgcctggcggccaacgccatctgctccgccgtgcccgtggactgggtccccaccagccggaccacgtggagcatccacgcgcaccaccagtggatgaccaccgaggacatgctgtccgtgtggaaccgcgtgtggatcgaggagaacccgtggatggaggacaagacccacgtcagctcctgggaggaggtgccctacctcggcaagcgcgaggaccagtggtgcggcagcctgatcgggctgacggcccgggccacctgggccaccaacatccaggtggccatcaaccaggtccgccggctcatcggcaacgagaactacctggactacatgacctccatgaagcgcttcaagaacgagagcgaccccgagggggcgctgtggtga

SEQ ID NO: 8279 - RNA, 9879 nt, synthetic construct
  misc_feature 1..9879: note = derived and/or modified CDS sequence (opt1) from DENV-1__GQ868601__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagacctccgtgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacgcgcaccgagacctggatgagctccgagggcgcctggaagcagatccagaaggtggagacctgggccctgcggcaccccgggttcacggtgatcgccctgttcctcgcccacgcgatcggcaccagcatcacccagaaggggatcatcttcatcctgctgatgctcgtcaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgccccacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcacccggctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccggcaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccgcctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttcctcacccaggacgagaagggggtcacccagaacggccggctgatcacggccaacccgatcgtgaccgacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcccggcgcatggccatcctgggcgacacggcctgggacttcgggtccatcggcggcctgttcaccagcgtggggaagctcatccaccaggtcttcggcaccgcgtacggggtgctgttctccggcgtgagctggaccatgaagatcgggatcggcatcctgctcacgtggctgggcctgaactcccgcagcacctccctcagcatgacctgcatcgccgtcgggatggtgaccctgtacctgggcgtgatggtccaggccgactccgggtgcgtgatcaactggaagggccgggagctcaagtgcgggagcggcatcttcgtgacgaacgaggtccacacctggaccgagcagtacaagttccaggccgactccccgaagcgcctgagcgccgcgatcggcaaggcctgggaggagggggtgtgcggcatccggagcgccacccgcctggagaacatcatgtggaagcagatctccaacgagctcaactacatcctgctggagaacgacatgaagttcaccgtggtcgtgggggacgccaacggcatcctcgcccaggggaagaagatgatccggccccagcccatggagcacaagtacagctggaagtcctggggcaaggcgaagatcatcggcgccgacatccagaacacgaccttcatcatcgacgggcccgacaccccggagtgccccgacgaccagcgcgcctggaacatctgggaggtggaggactacggcttcgggatcttcaccacgaacatctggctgaagctgcgggacagctacacccagatgtgcgaccaccgcctcatgtccgccgcgatcaaggacagcaaggccgtccacgccgacatgggctactggatcgagtccgagaagaacgagacctggaagctggcccgggccagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgcgggcccctggcacctggggaagctggagctcgacttcgacctgtgcgagggcaccacggtcgtggtggacgagcactgcggctaccgggggccgtccctgcgcaccaccaccgtcacgggcaagatcatccacgagtggtgctgccggagctgcaccctgccgcccctgcgcttccgcggggaggacggctgctggtacgggatggagatccgccccgtgaaggagaaggaggagaacctggtgcggtccatggtcagcgccggctccggcgaggtggacagcttcagcctcgggatcctgtgcgtgtccatcctgatcgaggaggtcatgcgcagccggtggtcccgccgcatgctcatgaccggcaccctggccgtgttcctgctcctgatcatggggcagctgacgtggaacgacctcatccggctgtgcatcatggtgggcgccaacgccagcgaccgcatggggatgggcaccacctacctggcgctcatggccaccttcaagatgcggccgatgttcgccgtcggcctgctgttccgccggctcacgtcccgcgaggtgctgctgctcaccatcgggctgagcctggtggcctccgtcgagctccccaacagcctggaggagctgggcgacgggctcgccatgggcatcatgatgctgaagctgctcaccgacttccagccccaccagctgtggaccacgctgctctccctgaccttcatccggaccaccctgagcctcgactacgcgtggaagacgatggccatggccctgtccatcgtgagcctgttccccctctgcctgtccaccaccagccagaagaccacgtggctgccggtcctcctgggctccttcgggtgcaagcccctgaccatgttcctcatcaccgagaacaagatctggggccgcaagagctggcccatcaacgaggggatcatggccgtgggcatcgtgtccatcctgctgagctccctcctgaagaacgacgtccccctggcggggccgctcatcgccggcggcatgctgatcgcctgctacgtgatcagcgggagctccgccgacctgagcctcgagaaggccgcggaggtgtcctgggaggaggaggccgagcacagcggcacctcccacaacatcctggtcgaggtgcaggacgacgggaccatgaagatcaaggacgaggagcgggacgacacgctgaccatcctcctgaaggccaccctgctcgccgtgagcggcgtctaccccatgtccatccccgccaccctgttcgtgtggtacttctggcagaagaagaagcagcgcagcggggtgctgtgggacacgccctccccgcccgaggtcgagcgggcggtgctggacgacggcatctaccgcatcctccagcggggcctgctggggcgcagccaggtgggcgtcggggtgttccaggacggcgtgttccacaccatgtggcacgtcacccgcggggccgtgctcatgtaccagggcaagcgcctggagccctcctgggccagcgtgaagaaggacctgatctcctacggcgggggctggcggttccaggggagctggaacaccggcgaggaggtccaggtgatcgccgtggagcccgggaagaacccgaagaacgtccagacgacccccggcaccttcaagacccccgagggcgaggtgggggccatcgcgctcgacttcaagcccggcacgtccgggagcccgatcgtgaaccgcgagggcaagatcgtcggcctgtacgggaacggcgtggtgaccacctccgggacctacgtcagcgccatcgcccaggccaaggcctcccaggagggccccctgcccgagatcgaggacgaggtgttcaagaagcggaacctcacgatcatggacctgcacccggggagcggcaagacccgccggtacctgcccgcgatcgtgcgcgaggccatcaagcgcaagctccggaccctgatcctggcccccacccgcgtcgtggccagcgagatggcggaggccctcaagggcatgcccatccggtaccagacgaccgccgtgaagtccgagcacaccgggcgcgagatcgtcgacctgatgtgccacgccaccttcacgatgcggctgctcagcccggtgcgcgtgcccaactacaacatgatcatcatggacgaggcccacttcaccgaccccgcgtccatcgccgcccggggctacatcagcacccgcgtcgggatgggcgaggccgccgcgatcttcatgaccgccacgcccccggggtccgtggaggccttcccccagagcaacgccgtgatccaggacgaggagcgggacatccccgagcgctcctggaacagcggctacgactggatcaccgacttccccggcaagaccgtctggttcgtgccgtccatcaagagcgggaacgacatcgccaactgcctgcggaagaacggcaagcgcgtgatccagctgtcccggaagaccttcgacacggagtaccagaagaccaagaacaacgactgggactacgtcgtgaccaccgacatcagcgagatgggggcgaacttccgcgccgaccgggtgatcgacccccgccggtgcctcaagcccgtcatcctgaaggacggccccgagcgcgtgatcctggccgggccgatgcccgtgacggtcgcctccgcggcccagcggcgcggccgcatcggccggaaccagaacaaggagggggaccagtacatctacatgggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgcgcggggaggcccggaagaccttcgtggagctgatgcgccggggcgacctccccgtctggctgtcctacaaggtggccagcgagggcttccagtactccgaccgccggtggtgcttcgacggggagcgcaacaaccaggtgctggaggagaacatggacgtcgagatctggacgaaggagggcgagcggaagaagctccgcccccggtggctggacgcccgcacctacagcgacccgctggcgctccgggagttcaaggagttcgccgccgggcgccggtccgtgagcggcgacctgatcctggagatcggcaagctcccccagcacctgaccctgcgcgcccagaacgccctcgacaacctggtgatgctgcacaacagcgagcagggcgggaaggcgtaccggcacgccatggaggagctccccgacaccatcgagaccctgatgctgctcgccctgatcgccgtcctgaccggcggggtgaccctcttcttcctgtccgggaaggggctgggcaagaccagcatcgggctcctgtgcgtgatggcgtccagcgccctgctctggatggcctccgtcgagccccactggatcgccgccagcatcatcctggagttcttcctgatggtgctcctgatcccggagcccgaccgccagcggacgccccaggacaaccagctggcgtacgtggtcatcggcctcctgttcatgatcctgacggtggccgccaacgagatggggctcctggagaccaccaagaaggacctgggcatcgggcacgtggccgccgagaaccaccaccacgcgaccatgctcgacgtcgacctgcgcccggcctccgcctggacgctgtacgccgtggccaccaccgtgatcacccccatgatgcgccacacgatcgagaacaccaccgcgaacatcagcctcaccgccatcgccaaccaggccgccatcctgatgggcctggacaagggctggcccatctccaagatggacatcggggtccccctcctggcgctgggctgctacagccaggtgaacccgctcacgctgaccgccgccgtgctgatgctcgtcgcccactacgcgatcatcgggcccggcctgcaggccaaggccacccgggaggcccagaagcgcaccgccgcggggatcatgaagaaccccacggtggacggcatcgtgaccatcgacctggaccccgtcgtgtacgacgccaagttcgagaagcagctcggccagatcatgctgctgatcctctgcacctcccagatcctgctgatgcggaccacgtgggccctctgcgagagcatcaccctggccaccgggccgctgaccacgctctgggagggctcccccgggaagttctggaacaccaccatcgccgtgagcatggcgaacatcttccgcggctcctacctggccggcgccgggctggccttcagcctcatgaagtccctgggcgggggccggcgcgggaccggcgcccagggcgagacgctgggggagaagtggaagcggcagctcaaccagctgagcaagtccgagttcaacacctacaagcgcagcggcatcatggaggtcgaccggagcgaggcgaaggaggggctgaagcgcggcgagaccaccaagcacgccgtgtcccgggggacggccaagctgcgctggttcgtggagcggaacctcgtcaagcccgagggcaaggtgatcgacctgggctgcgggcgcggcgggtggagctactactgcgccggcctgaagaaggtgaccgaggtcaaggggtacaccaagggcggccccgggcacgaggagccgatccccatggcgacctacggctggaacctcgtgaagctgcactccgggaaggacgtgttcttcacgccgcccgagaagtgcgacacgctgctctgcgacatcggcgagagctccccgaaccccaccatcgaggaggggcggaccctgcgcgtcctgaagatggtggagccctggctccggggcaaccagttctgcatcaagatcctgaacccctacatgccgagcgtggtcgagaccctggagcagatgcagcgcaagcacggcgggatgctcgtgcggaaccccctgtcccgcaacagcacgcacgagatgtactgggtgtcctgcggcaccgggaacatcgtcagcgccgtgaacatgacctcccgcatgctgctcaaccggttcaccatggcccaccgcaagcccacgtacgagcgggacgtggacctgggcgccggcacccgccacgtcgccgtggagcccgaggtggcgaacctggacatcatcgggcagcggatcgagaacatcaagaacgagcacaagagcacctggcactacgacgaggacaacccgtacaagacctgggcctaccacggctcctacgaggtcaagcccagcgggtccgccagctccatggtgaacggcgtggtccgcctcctgacgaagccctgggacgtgatccccatggtcacccagatcgccatgaccgacaccacgccgttcgggcagcagcgggtgttcaaggagaaggtggacacccgcacgccccgggccaagcgcggcaccgcgcagatcatggaggtcacggccaagtggctgtggggcttcctcagccggaacaagaagccccgcatctgcacccgggaggagttcacccgcaaggtgcggtccaacgccgccatcggggccgtgttcgtcgacgagaaccagtggaacagcgcgaaggaggccgtggaggacgagcgcttctgggacctggtgcaccgggagcgcgagctgcacaagcagggcaagtgcgcgacctgcgtctacaacatgatggggaagcgggagaagaagctcggcgagttcgggaaggccaagggcagccgcgcgatctggtacatgtggctgggcgcccggttcctggagttcgaggccctcgggttcatgaacgaggaccactggttctcccgcgagaacagcctgtccggcgtggagggggagggcctgcacaagctcgggtacatcctgcgcgacatcagcaagatcccgggcggcaacatgtacgccgacgacacggccgggtgggacacccggatcaccgaggacgacctgcagaacgaggcgaagatcaccgacatcatggagcccgagcacgccctcctggccacgtccatcttcaagctgacctaccagaacaaggtggtccgcgtgcagcggcccgccaagagcggcaccgtgatggacgtcatctcccgccgggaccagcgcgggagcggccaggtgggcacctacgggctcaacacgttcaccaacatggaggtgcagctgatccggcagatggagtccgagggcatcttcagcccctccgagctggagaccccgaacctcgccaagcgcgtcctggactggctggagaagcagggggcggagcggctcaagcgcatggccatcagcggcgacgactgcgtggtgaagcccatcgacgaccggttcgccaccgccctgacggccctgaacgacatggggaaggtccgcaaggacatcccccagtgggagccctccaagggctggaacgactggcagcaggtcccgttctgcagccaccacttccaccagctcatcatgaaggacggccgggagatcgtggtcccctgccgcaaccaggacgagctggtggggcgggcgcgcgtgtcccagggcgccgggtggagcctgcgggagaccgcctgcctcggcaagtcctacgcccagatgtggcagctgatgtacttccaccgccgggacctgcgcctcgccgcgaacgccatctgcagcgccgtccccgtggactgggtgcccaccagccgcaccacctggtccatccacgcccaccaccagtggatgacgaccgaggacatgctgagcgtctggaaccgggtgtggatcgaggagaacccgtggatggaggacaagacccacgtgtccagctgggaggaggtcccctacctggggaagcgcgaggaccagtggtgcggctccctcatcggcctgaccgcgcgggccacgtgggccaccaacatccaggtggccatcaaccaggtgcgccggctgatcgggaacgagaactacctcgactacatgaccagcatgaagcgcttcaagaacgagtccgaccccgagggcgccctgtggtga

SEQ ID NO: 8280 - RNA, 9879 nt, synthetic construct
  misc_feature 1..9879: note = derived and/or modified CDS sequence (opt1) from DENV-1__EU660390__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtgatcgtgggggacgtcgcgggcatcctggggcagggccggaagatgatccgcccccagcccatggagtacaagtacagctggaagtcctggggcaaggccaagatcatcggggccgacgcccagaacacgaccttcatcatcgacggccccaacaccccggagtgccccgacgaccagcgggcgtggaacatctgggaggtggaggactacgggttcggcatcttcaccacgaacatctggctgaagctccgcgacagctacacccaggtgtgcgaccaccggctgatgtccgccgccatcaaggacagcaaggccgtccacgccgacatgggctactggatcgagtccgagaagaacgagacctggaagctggcgcgcgccagcttcatcgaggtgaagacctgcatctggcccaagtcccacacgctctggagcaacggggtgctggagtccgagatgatcatccccaagatctacggcgggccgatcagccagcacaactaccggcccggctacttcacccagaccgccgggccctggcacctgggcaagctcgagctggacttcgacctgtgcgagggcaccacggtcgtggtggacgagcactgcgggaaccgcggcccgtccctccggaccaccaccgtcacggggaagatcatccacgagtggtgctgccgcagctgcaccctgccgcccctgcggttccgcggcgaggacgggtgctggtacggcatggagatccggcccgtgaaggagaaggaggagaacctcgtgaagtccatggtcagcgccggcagcggggaggtggactccttcagcctgggcctgctctgcatctccatcatgatcgaggaggtgatgcgcagccggtggtcccgcaagatgctgatgaccgggaccctggccgtcttcttcctcctgatcatgggccagctgacgtggaacgacctcatccgcctgtgcatcatggtgggggcgaacgccagcgaccggatgggcatgggcaccacctacctggccctcatggccaccttcaagatgcgcccgatgttcgccgtggggctgctgttccggcgcctcacgtcccgggaggtcctgctgctcaccatcggcctgagcctggtggcgtccgtggagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcctggaagaccatggcgatggtcctcagcatcgtgtccctgttccccctgtgcctcagcacgacctcccagaagaccacctggctgcccgtcctgctcgggagcctgggctgcaagccgctgacgatgttcctcatcgccgagaacaagatctgggggcgcaagtcctggcccctgaacgagggcatcatggccgtggggatcgtgagcatcctgctcagctccctgctgaagaacgacgtccccctcgccggccccctggtggccggcgggatgctgatcgcgtgctacgtgatcagcggctccagcgccgacctctccctggagaaggccgccgaggtcagctgggaggaggaggccgagcactccggggcgagccacaacatcctggtggaggtgcaggacgacggcaccatgaagatcaaggacgaggagcgggacgacaccctcaccatcctgctgaaggccaccctcctggccgtctccggggtgtacccgctgagcatccccgccaccctcttcgtgtggtacttctggcagaagaagaagcagcgctccggcgtcctgtgggacacccccagcccgcccgaggtggagcgggccgtgctggacgacggcatctaccgcatcatgcagcgggggctgctcggccgctcccaggtcggggtgggcgtgttccaggagaacgtcttccacaccatgtggcacgtgacccgcggggccgtgctgatgtaccagggcaagcgcctggagcccagctgggcctccgtcaagaaggacctcatcagctacggcgggggctggcggctgcgcgggtcctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgagcgggtcccccatcgtcaaccgggagggcaagatcgtgggcctctacgggaacggcgtggtcaccaccagcgggacctacgtgagcgccatcgcccaggccaaggcgtcccaggagggcccgctgcccgagatcgaggacgaggtgttccgcaagcggaacctgacgatcatggacctccaccccgggagcggcaagacccgccggtacctgccggccatcgtccgcgaggccatcaagcgcaagctgcggaccctcatcctggcccccacccgcgtggtggcctccgagatggcggaggccctgaagggcatgcccatccggtaccagacgaccgccgtcaagagcgagcacaccgggaaggagatcgtggacctcatgtgccacgccaccttcacgatgcgcctgctgtcccccgtgcgggtcccgaactacaacatgatcatcatggacgaggcccacttcaccgaccccagctccatcgcggcccgcggctacatcagcacccgggtggggatgggcgaggccgccgccatcttcatgaccgcgacgccgcccgggtccgtggaggccttcccgcagagcaacgccgtcatccaggacgaggagcgcgacatccccgagcggtcctggaacagcggctacgagtggatcaccgacttccccggcaagaccgtgtggttcgtgccctccatcaagagcgggaacgacatcgccaactgcctccgcaagaacggcaagcgggtcatccagctgtcccgcaagaccttcgacacggagtaccagaagaccaagaacaacgactgggactacgtggtgaccaccgacatcagcgagatgggggcgaacttccgggccgaccgcgtcatcgacccgcggcgctgcctgaagcccgtgatcctcaaggacggccccgagcgggtgatcctggccgggcccatgccggtcacggtggcctccgccgcgcagcgccggggccgcatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgggagaagtccgccgcggtcgacggcgagtaccgcctccgcggggaggcccgcaagaccttcgtggagctgatgcggcgcggcgacctgcccgtgtggctctcctacaaggtcgccagcgagggcttccagtacagcgaccggcgctggtgcttcgacggggagcggaacaaccaggtgctggaggagaacatggacgtggagatctggacgaaggagggcgagcgcaagaagctgcggccccgctggctcgacgcccggacctactccgaccccctggccctgcgcgagttcaaggagttcgcggccgggcggcgcagcgtctccggcgacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtgctcaccgggggcgtcaccctgttcttcctgtccgggcgcggcctcggcaagaccagcatcgggctgctgtgcgtgatggcctccagcgtgctcctgtggatggcgtccgtcgagccccactggatcgccgccagcatcatcctggagttcttcctcatggtgctgctgatccccgagccggaccggcagcgcacgccccaggacaaccagctcgcctacgtggtcatcggcctgctgttcatgatcctcacggtggccgcgaacgagatggggctgctggagaccaccaagaaggacctcggcatcgggcacgtggccgtcgagaaccaccaccacgccgccatgctggacgtggacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtccccctgctggccctcggctgctacagccaggtgaaccccctgaccctgacggcggccgtgctcatgctggtcgcccactacgccatcatcgggccgggcctgcaggccaaggcgacccgggaggcccagaagcgcaccgccgccgggatcatgaagaaccccaccgtggacggcatcgtggccatcgacctcgaccccgtcgtgtacgacgcgaagttcgagaagcagctgggccagatcatgctgctcatcctgtgcacgtcccagatcctgctcatgcggaccacctgggccctgtgcgagagcatcaccctggccacggggcccctcaccaccctgtgggagggctccccggggaagttctggaacaccacgatcgccgtgagcatggccaacatcttccgcggctcctacctggcgggcgccgggctcgccttcagcctgatgaagtccctgggcgggggccggcgcgggaccggcgcccagggcgagaccctcggggagaagtggaagcggcagctgaaccagctgtccaagagcgagttcaacacctacaagcgctccggcatcatggaggtcgaccggagcgaggcgaaggaggggctcaagcgcggcgagacgaccaagcacgccgtgtcccgggggaccgccaagctgcgctggttcgtggagcggaacctggtcaagcccgagggcaaggtgatcgacctgggctgcgggcgcggcgggtggagctactactgcgccggcctcaagaaggtgaccgaggtcaaggggtacacgaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgaccatcgaggaggggcggacgctgcgcgtcctcaagatggtggagccctggctgcggggcaaccagttctgcatcaagatcctgaacccctacatgcccagcgtggtcgagaccctcgagcagatgcagcgcaagcacggcgggatgctggtgcggaacccgctgtcccgcaacagcacccacgagatgtactgggtgtcctgcggcaccgggaacatcgtcagcgcggtgaacatgacctcccgcatgctcctgaaccggttcacgatggcccaccgcaagcccacctacgagcgggacgtggacctgggcaccggcacccgccacgtcgccgtggagcccgaggtggccaacctcgacatcatcgggcagcggatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctgctgaccaagccctgggacgtgatccccatggtcacccagatcgccatgacggacaccacccccttcgggcagcagcgcgtgttcaaggagaaggtggacacccggacgccgaaggccaagcgcggcaccgcccagatcatggaggtcaccgcccggtggctctggggcttcctgtcccgcaacaagaagccccggatctgcacccgcgaggagttcacgcggaaggtgcgcagcaacgcggccatcggggccgtgttcgtcgacgagaaccagtggaactccgccaaggaggcggtggaggacgagcggttctgggacctggtgcaccgcgagcgggagctccacaagcagggcaagtgcgcgacctgcgtctacaacatgatggggaagcgcgagaagaagctgggcgagttcgggaaggccaagggcagccgggccatctggtacatgtggctgggcgcccgcttcctcgagttcgaggcgctggggttcatgaacgaggaccactggttctcccgggagaacagcctgtccggcgtggagggggagggcctccacaagctggggtacatcctgcgcgacatcagcaagatccccggcggcaacatgtacgccgacgacaccgccgggtgggacacccgcatcacggaggacgacctccagaacgaggccaagatcaccgacatcatggagccggagcacgccctgctggcgaaggccatcttcaagctcacctaccagaacaaggtggtccgggtgcagcgccccgccaagaacggcaccgtgatggacgtcatctcccggcgcgaccagcgggggagcggccaggtgggcacgtacgggctgaacaccttcaccaacatggaggcccagctgatccgccagatggagtccgagggcatcttcagcccctccgagctcgagacccccaacctggccgagcgggcgctggactggctcgagaagtacggggtggagcgcctgaagcggatggccatcagcggcgacgactgcgtcgtgaagccgatcgacgaccgcttcgccacggccctgaccgccctcaacgacatggggaaggtgcggaaggacatcccccagtgggagccctccaagggctggaacgactggcagcaggtccccttctgcagccaccacttccaccagctgatcatgaaggacggccgcgagatcgtggtgccgtgccggaaccaggacgagctggtcgggcgcgcgcgggtgtcccagggcgccgggtggagcctccgcgagaccgcctgcctgggcaagagctacgcccagatgtggcagctgatgtacttccaccggcgcgacctccggctggcggccaacgccatctgctccgccgtgcccgtcgactgggtgcccaccagccgcacgacctggtccatccacgcccaccaccagtggatgaccaccgaggacatgctgagcgtgtggaaccgcgtctggatcgaggagaacccctggatggaggacaagacgcacatctccagctgggaggacgtgccgtacctcgggaagcgggaggaccagtggtgcggctccctgatcggcctgaccgcgcgcgccacctgggccaccaacatccaggtggccatcaaccaggtccggcgcctcatcgggaacgagaactacctggactacatgaccagcatgaagcggttcaagaacgagtccgaccccgagggcgccctgtggtga

SEQ ID NO: 8281 - RNA, 9879 nt, synthetic construct
  misc_feature 1..9879: note = derived and/or modified CDS sequence (opt1) from DENV-1__EU660391__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtgggcctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggacgatgaagatcaaggacgaggagcgggacgacaccctgaccatcctgctcaaggccaccctgctggccgtgagcggcgtgtacccgctctccatccccgccaccctgttcgtctggtacttctggcagaagaagaagcagcgcagcggggtgctgtgggacacgcccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacaccggggaggaggtgcaggtcatcgccgtggagcccggcaagaaccccaagaacgtgcagacggcccccgggaccttcaagacctccgagggcgaggtcggcgccatcgcgctcgacttcaagcccgggaccagcggcagccccatcgtgaaccgcgaggggaagatcgtgggcctgtacggcaacggggtcgtgacgacctccggcacctacgtgagcgccatcgcccaggccaaggcgtcccaggacgggcccctgccggagatcgaggacgaggtcttccggaagcgcaacctcaccatcatggacctgcaccccggcagcgggaagacgcggcgctacctgcccgccatcgtgcgggaggccatcaagcgcaagctccggaccctgatcctggccccgacccgcgtggtcgcctccgagatggcggaggccctcaagggcatgcccatccgctaccagaccacggccgtcaagagcgagcacaccggcaaggagatcgtggacctgatgtgccacgccaccttcaccatgcggctgctctcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctgcggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgacgggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagacgaccaagaaggacctggggatcggccacgtggccgtcgagaaccaccaccacgccgccatgctggacgtggacctccaccccgcctccgcgtggaccctgtacgccgtggccaccacgatcatcacccccatgatgcgccacaccatcgagaacaccacggccaacatcagcctgaccgccatcgcgaaccaggccgccatcctcatggggctggacaagggctggccgatctccaagatggacatcggcgtccccctgctcgccctggggtgctacagccaggtgaaccccctgaccctcaccgcggccgtgctgatgctggtcgcccactacgccatcatcggccccgggctccaggccaaggcgacgcgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtgagcatggccaacatcttccgggggagctacctcgcgggcgccggcctggccttctccctgatgaagtccctcgggggcgggcgccggggcacgggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagaccacgaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggccacgtacgggtggaacctggtgaagctccactccggcaaggacgtgttcttcatcccgcccgagaagtgcgacaccctgctgtgcgacatcggggagagctcccccaaccccaccatcgaggagggccgcaccctccgggtcctgaagatggtggagccgtggctgcgcgggaaccagttctgcatcaagatcctcaacccctacatgcccagcgtggtcgagacgctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcaccatggcccaccgcaagccgacgtacgagcgcgacgtggacctcggggccggcacccggcacgtcgccgtggagcccgaggtggccaacctggacatcatcggccagcgcatcgagaacatcaagtacgagcacaagagcacctggcactacgacgaggacaacccctacaagacctgggcgtaccacgggtcctacgaggtcaagcccagcggcagcgcctccagcatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacacggccggctgggacacccggatcaccgaggacgacctgcagaacgaggccaagatcaccgacatcatggagcccgagcacgcgctgctcgccaagtccatcttcaagctgacgtaccagaacaaggtggtccgcgtgcagcggccggccaagaacgggaccgtgatggacgtcatcagccgccgcgaccagcggggctccggccaggtgggcacctacggcctgaacaccttcacgaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccaccgccctcaccgccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagacggcctgcctgggcaagtcctacgcccagatgtggcagctcatgtacttccaccggcgcgacctgcggctggccgcgaacgccatctgcagcgccgtcccggtggactgggtgcccacctcccgcaccacctggagcatccacgcccaccaccagtggatgacgaccgaggacatgctctccgtctggaaccgggtgtggatcgaggagaacccctggatggaggacaagacccacatcagctcctgggaggacgtgccctacctggggaagcgcgaggaccagtggtgcggcagcctgatcggcctcaccgcccgggcgacgtgggccaccaacatccaggtcgccatcaaccaggtgcgccgcctgatcgggaacgagaactacctggactacatgacctccatgaagcggttcaagaacgagagcgacccggagggcgccctctggtga
